United States Patent
Zhang et al.

(10) Patent No.: US 11,965,185 B2
(45) Date of Patent: Apr. 23, 2024

(54) LACHNOSPIRACEAE SP. CAS12A MUTANTS WITH ENHANCED CLEAVAGE ACTIVITY AT NON-CANONICAL TTTT PROTOSPACER ADJACENT MOTIFS

(71) Applicant: INTEGRATED DNA TECHNOLOGIES, INC., Coralville, IA (US)

(72) Inventors: Liyang Zhang, North Liberty, IA (US); Christopher Anthony Vakulskas, North Liberty, IA (US)

(73) Assignee: INTEGRATED DNA TECHNOLOGIES, INC., Coralville, IA (US)

( * ) Notice: Subject to any disclaimer, the term of this patent is extended or adjusted under 35 U.S.C. 154(b) by 0 days.

(21) Appl. No.: 17/245,401

(22) Filed: Apr. 30, 2021

(65) Prior Publication Data

US 2021/0348144 A1    Nov. 11, 2021

Related U.S. Application Data

(60) Provisional application No. 63/090,912, filed on Oct. 13, 2020, provisional application No. 63/018,592, filed on May 1, 2020.

(51) Int. Cl.
*C12N 9/22* (2006.01)

(52) U.S. Cl.
CPC ..................... *C12N 9/22* (2013.01)

(58) Field of Classification Search
CPC ..................................... C12N 9/22
See application file for complete search history.

(56) References Cited

U.S. PATENT DOCUMENTS

| | | | |
|---|---|---|---|
| 7,560,529 B2 | 7/2009 | Gabibov et al. | |
| 9,840,702 B2 | 12/2017 | Collingwood et al. | |
| 10,266,886 B2 | 4/2019 | Abudayyeh et al. | |
| 10,717,978 B2 | 7/2020 | Vakulskas et al. | |
| 10,767,176 B2 | 9/2020 | Collingwood et al. | |
| 2016/0177304 A1 | 6/2016 | Collingwood et al. | |
| 2016/0208243 A1 | 7/2016 | Zhang et al. | |
| 2017/0044536 A1 | 2/2017 | Collingwood et al. | |
| 2018/0179523 A1 | 6/2018 | Collingwood et al. | |
| 2018/0187176 A1 | 7/2018 | Behlke et al. | |
| 2018/0273938 A1 | 9/2018 | Turk et al. | |
| 2018/0320201 A1 | 11/2018 | Vakulskas et al. | |
| 2019/0010481 A1 | 1/2019 | Joung et al. | |
| 2019/0032131 A1 | 1/2019 | Turk et al. | |
| 2020/0080096 A1 | 3/2020 | Flasinski et al. | |
| 2020/0109382 A1 | 4/2020 | Zhang et al. | |

FOREIGN PATENT DOCUMENTS

| | | | |
|---|---|---|---|
| WO | 2017127807 A1 | 7/2017 | |
| WO | 2017184768 A1 | 10/2017 | |
| WO | 2018195545 A2 | 10/2018 | |
| WO | 2019138052 A1 | 7/2019 | |
| WO | 2020172502 A1 | 8/2020 | |
| WO | WO-2020172502 A1 * | 8/2020 | ............ C12N 15/52 |
| WO | 2021093752 A1 | 5/2021 | |
| WO | 2023097316 A1 | 6/2023 | |

OTHER PUBLICATIONS

Studer. Residue mutations and their impact on protein structure and function: detecting beneficial and pathogenic changes. Biochem. J. (2013) 449, 581-594.*
Cebrian-Serrano et al., "CRISPR-Cas orthologues and variants: optimizing the repertoire, specificity and delivery of genome engineering tools", Mammalian Genome, 2017, vol. 28, No. 7, pp. 247-261.
Geneseq, "Lachnospiraceae bacterium Cpf1 gene (PL-LbCpf1-RR) encoded nuclease", Nov. 2017, EBI Accession No. GS_PROT:BEK39676, 1 pages.
International Search Report and Written Opinion for Application No. PCT/US2021/030089 dated May 20, 2022 (25 pages).
Abudayyeh et al., "C2c2 is a single component programmable RNA-guided RNA-targeting CRISPR effector", Science, vol. 353(6299), 2016.
Bowie et al., "Deciphering the Message in Protein Sequences: Tolerance to Amino Acid Substitutions", Science, vol. 247, 1990, pp. 1306-1310.
East-Seletsky et al., "Two distinct RNase activities of CRISPR-C2c2 enable guide-RNA processing and RNA detection", Nature, vol. 538 (7624), 2016, pp. 270-273.
Gao et al., "Engineered Cpf1 variants with altered PAM specificities increase genome targeting range", Nat Biotechnol., vol. 35, No. 8, 2017, pp. 789-792.
Gao et al., "Type V CRISPR-Cas Cas12a endonuclease employs a unique mechanism for crRNA-mediated target DNA recognition," Cell Research, vol. 26, 2016, pp. 901-913.
Gibson et al., "Enzymatic assembly of DNA molecules up to several hundred kilobases", Nature Methods, vol. 6, No. 5, 2009, pp. 343-334.
Gootenberg et al., "Nucleic acid detection with CRISPR-Cas13a/C2c2" Science, vol. 356(6336), 2017, pp. 438-442.
Hur et al., "Targeted mutagenesis in mice by electroporation of Cpf1 ribonucleoproteins," Nature Biotechnology 34(8): 807-808 (2016).
International Search Report and Written Opinion for Application No. PCT/US2020/19168 dated Jul. 23, 2020 (13 pages).
Jinek et al., "A programmable dual-RNA-guided DNA endonuclease in adaptive bacterial 5 immunity", Science, vol. 337, 2012, pp. 816-821.

(Continued)

*Primary Examiner* — Yong D Pak
(74) *Attorney, Agent, or Firm* — Michael Best & Friedrich LLP

(57) ABSTRACT

Described herein are CAS12A mutants from *Lachnospiraceae bacterium* and methods for use thereof. These mutants have enhanced DNA cleavage activities at non-canonical TTTT protospacer adjacent motifs (PAM) compared to the wild-type enzyme.

2 Claims, 8 Drawing Sheets

Specification includes a Sequence Listing.

(56) References Cited

OTHER PUBLICATIONS

Kim et al., "CRISPR/Cpf1-mediated DNA-free plant genome editing," Nature Commun., vol. 8(14406), 2017, pp. 1-7.
Kim et al., "Generation of knockdown mice by Cpf1-mediated gene targeting," Nature Biotechnology, vol. 34, No. 8, 2016, pp. 808-810.
Kim et al., "In vivo high-throughput profiling of CRISPR-Cpf1 activity," Nature Methods, vol. 14, No. 2, 2017, pp. 153-159.
Kleinstiver et al., "Engineered CRISPR-Cas 12a variants with increased activities and improved targerting ranges for gene, epigenetic and base editing", Nat. Biotechnol., vol. 37, 2019, pp. 276-282.
Kleinstiver et al., "Genome-wide specificities of CRISPR-Cas Cpf1 nucleases in human cells," Nature Biotechnology, vol. 34, No. 8, 2016, pp. 869-874.
Schindele et al., "Engineering CRISPR/LbCas12a for highly efficient, temperature tolerant plant gene editing", Plant Biotechnol J., vol. 18, No. 5, 2020, pp. 1118-1120.
Wrenbeck et al., "Plasmid-based one-pot saturation mutagenesis", Nat Methods, vol. 13, 2016, pp. 928-930.
Yamano et al., "Crystal Structure of Cpf1 in Complex with Guide RNA and Target RNA," Cell vol. 65, 2016, pp. 949-962.
Zetsche et al., "Cpf1 Is a Single RNA-Guided Endonuclease of a Class 2 CRISPR-Cas System", Cell, vol. 163, 2015, pp. 759-771.
Zetsche et al., "Multiplex gene editing by CRISPR-Cpf1 using a single rRNA array," Nature Biotechnology, vol. 35, No. 1, 2017, pp. 31-34.
Australian Patent Office Examination Report No. 1 for application 2020226864, dated Jan. 19, 2023 (4 pages).
Canadian Patent Office Action for application 3,130,087, dated Nov. 24, 2022 (6 pages).
Australian Patent Office Examination Report No. 2 for Application No. 2020226864, dated Jun. 26, 2023 (9 pages).
Carmignotto et al., "On the expression of recombinant Cas9 protein in *E. coli* BL21 (DE3) and BL21 (DE3) Rosetta strains," J Biotechnol. vol. 306:62-70 (epub Sep. 20, 2019) (Year: 2019).
Evans et al., "Concentration of proteins and removal of solutes," Methods Enzymol., vol. 463:97-120 (2009), PMID: 19892169 (Year: 2009).
Francis et al., "Strategies to Optimize Protein Expression in *E. coli*," Current Protocols in Protein Science, 5.24.1-5.24.29 (Aug. 2010) (Year: 2010).
Hi Trap SP HP cation exchange columns Protocol, SP Sepharose™ High Performance Ion Exchange Medium Instructions 18-1060-26-AG, GE Life Sciences, 20 pages (2014) (Year: 2014).
Livingstone et al., Protein sequence alignments, CABIOS, vol. 9(6):745-756 (1993) (Year: 1993).
PET System manual (Novagen, pET System Manual 10th Edition, 68 pages, published May 2003 (Year: 2003).
Rodrigues et al, Chapter 5: One-Step Isothermal Assembly of DNA Fragments, Synthetic Biology, Methods in Molecular Biology, vol. 1073:43-47 (2013) (Year: 2013).
Spriestersbach et al., "Purification of His-Tagged Proteins," Methods Enzymol., vol. 559:1-15, PMID: 26096499 (Epub May 4, 2015) (Year: 2015).
Japanese Patent Office Notification of Reasons for Rejection for Application No. 2021-548687, dated Aug. 4, 2023, 14 pages with translation.
Chinese Patent Office Notification of First Office Action for Application No. 202080015167.9, dated Sep. 27, 2023, 17 pages with translation.
Lu Yifan et al., LbCpf1 "Prokaryotic Expression, Purification of LbCpf1 Protein Gene and in Vitro Cleavage Activity Assay." China Biotechnology 40.8 (2020): 41-48. With English Abstract.
Zhang, Y., et al. "Highly efficient genome editing in plant protoplasts by ribonucleoprotein delivery of CRISPR-Cas12a nucleases." Frontiers in Genome Editing 4 (2022): 780238.
Yamano T., "Structural basis for the canonical and non-canonical PAM recognition by CRISPR-Cpf1." Molecular cell 67.4 (2017): 633-645.
European Patent Office Extended European Search Report for Application No. 20760344.0, dated Feb. 26, 2024 (8 pages).
Canadian Patent Office Action for application 3,130,087, dated Feb. 19, 2024 (3 pages).

\* cited by examiner

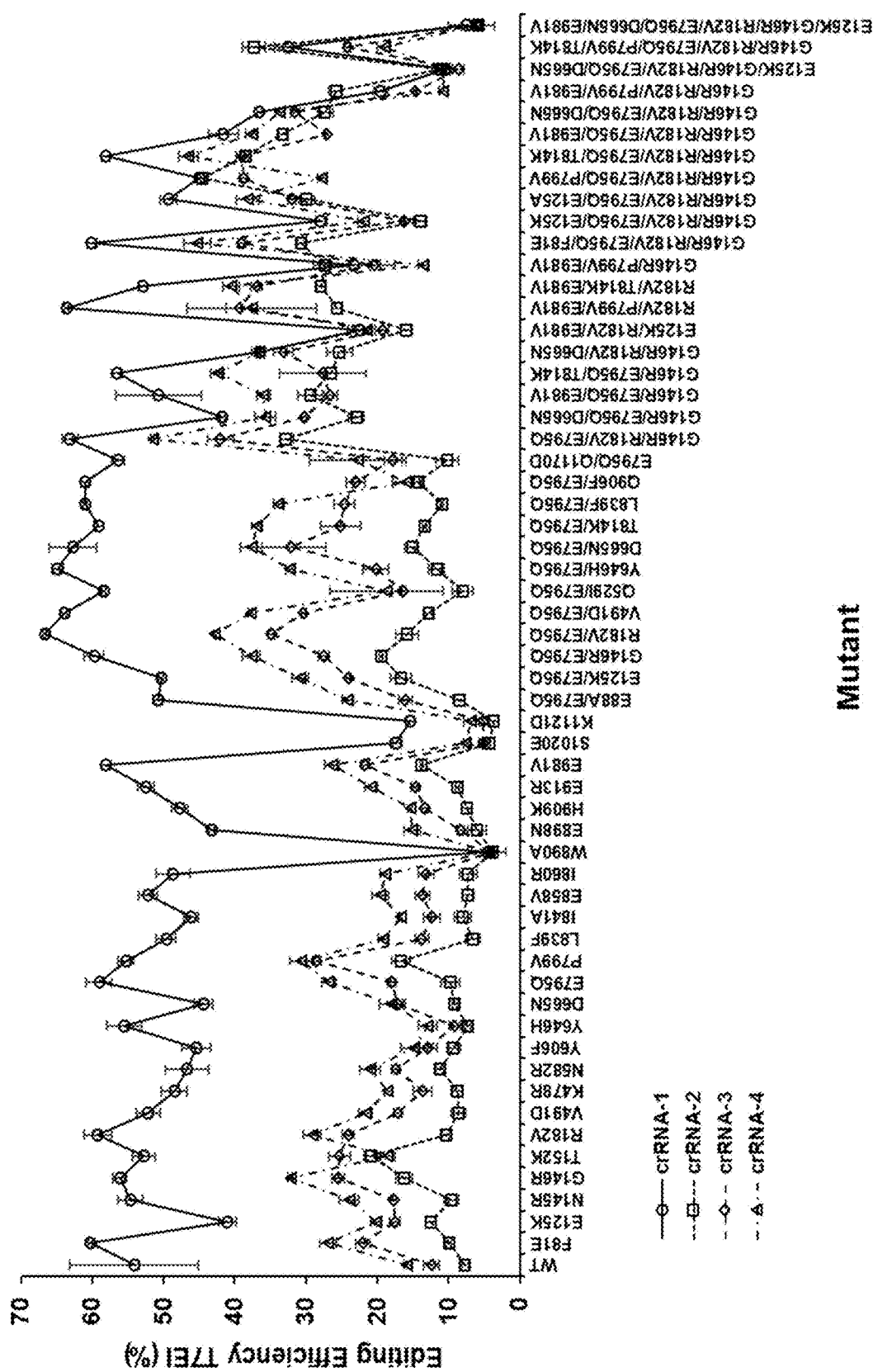

LACHNOSPIRACEAE SP. CAS12A MUTANTS WITH ENHANCED CLEAVAGE ACTIVITY AT NON-CANONICAL TTTT PROTOSPACER ADJACENT MOTIFS

CROSS-REFERENCE TO RELATED APPLICATIONS

This application claims priority to U.S. Provisional Patent Application No. 63/018,592, filed on May 1, 2020, and 63/090,912, filed on Oct. 13, 2020, the contents of each of which are incorporated by reference herein in its entirety. This application is related to International Application No. PCT/US2020/019168, filed on Feb. 21, 2020 and published as International Patent Application No. WO 202/0172502 A1 on Aug. 27, 2020, which is incorporated by reference herein in its entirety.

REFERENCE TO SEQUENCE LISTING

This application is filed with a Computer Readable Form of a Sequence Listing in accord with 37 C.F.R. § 1.821(c). The text file submitted by EFS, "013670-9067-US02_sequence_listing_27-APR-2021_ST25.K" was created on Apr. 27, 2021, contains 5320 sequences, has a file size of 30.2 Megabytes, and is hereby incorporated by reference in its entirety.

TECHNICAL FIELD

Described herein are Cas12a mutants from Lachnospiraceae bacterium and methods for use thereof. These mutants have enhanced DNA cleavage activities at non-canonical TTTT protospacer adjacent motifs (PAM) compared to the wild-type enzyme.

BACKGROUND

LbCas12a is an RNA-guided endonuclease from the Lachnospiraceae bacterium ND2006 (Lb) species Clustered Regularly Interspaced Short Palindromic Repeat (CRISPR) adaptive immune system. See Zetsche et al. *Cell* 163: 759-771 (2015). Cas12a nucleases are classified as a class 2 type V CRISPR system that provide a staggered DNA double-stranded break with a 5-nucleotide 5'-overhang when complexed with a CRISPR RNA (crRNA). The LbCas12a:crRNA complex is referred to as a CRISPR ribonucleoprotein (RNP) complex.

Cas12a is guided to a 21-24 nucleotide DNA target sequence, or commonly referred as protospacer, by a target site-specific 21-24 nucleotide complementary guide RNA (gRNA). The Cas12a-gRNA RNP complex mediates double-stranded DNA breaks (DSBs), which are then repaired by either the non-homologous end joining (NHEJ, typically introduces mutations or indels at the cut site), or the homology directed repair (HDR) system for precise editing if a suitable template nucleic acid is present.

The recognition of the correct DNA target by LbCas12a requires both crRNA and the canonical "TTTV" protospacer adjacent motif (PAM), which is a 4-bp sequence immediately upstream of the protospacer, in contrast to the 2-bp NGG PAM of Cas9 from *Streptococcus pyogenes*. See Jinek et al., *Science* 337: 816-821 (2012). Cas12a expanded the targetable loci in genome editing, particularly over the T-rich sites that are inaccessible to the Cas9 system. Although the occurrence of targetable sites of Cas12a on the genome is less frequent than Cas9, LbCas12a has gained significant popularity in the genome engineering of plants, owing to editing activity at ambient temperatures (20-30° C.). Improving the cleavage activity and associated genome editing efficiency of LbCas12a would greatly facilitate the development of agriculture products with enhanced properties.

It is desirable to further improve the utility of LbCas12a by enhancing its on-target activity through protein mutagenesis. Previous studies have been performed to improve the utility of Cas12a from Acidaminococcus sp. (also known as AsCas12a). See U.S. Patent App. Publication No. US 2020/0109382 A1, which is incorporated by reference herein. However, transferring the beneficial mutations identified in AsCas12a to the LbCas12a polypeptide sequence has not been simple. Despite significant structural and sequence similarity between the two homologous Cas12a enzymes, most point mutations that improved the activity of AsCas12a are detrimental to LbCas12a. See Schindele and Puchta, *Plant Biotechnol. J.* 18(5):1118-1120 (2020).

What are needed are novel LbCas12a mutants that enhance the activity of this enzyme at non-canonical TTTT protospacer adjacent motifs, particularly in human cells.

SUMMARY

One embodiment described herein is an isolated mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence. In one aspect, the mutant LbCas12a polypeptide has 95% to 99% identity to a polypeptide sequence selected from the even numbered sequences of SEQ ID NO: 4-4022. In another aspect, the mutant LbCas12a polypeptide has a polypeptide sequence selected from the even numbered sequences of SEQ ID NO: 4-4022. In another aspect, the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2. In another aspect, the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2. In another aspect, the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598. In another aspect, the mutant LbCas12a polypeptide comprises a substitution mutation selected from: (a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or (b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121. In another aspect, the multiple substitution mutations comprise: E88A/E795Q, E125K/E795Q, G146R/E795Q, R182V/E795Q, V491D/E795Q, Q5291/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, G146R/R182V/E795Q/P799V/T814K, or E125K/G146R/R182V/E795Q/D665N/E981V. In another aspect, the multiple substitution mutations comprise: E88A/E795Q, E125K/E795Q, G146R/E795Q, R182V/E795Q, V491D/E795Q, Q5291/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K, and provide an improvement in CRISPR/LbCas12a-associated nuclease activity at non-canonical TTTT PAM sites as compared to the wild-type LbCas12a polypeptide sequence. In another aspect, the mutant LbCas12a polypeptide is selected from SEQ ID NO: 802, 428, 2902, 156, 694, 98, 954, 134, 1730, 642, 720, 1014, 930, 706, 834, 988, 114, 250, 3958, 48, 70, 1960, 880, 532, 598, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, or 4022. In another aspect, the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q5291/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020). In another aspect, the mutant LbCas12a polypeptide is G146R/R182V/E795Q (SEQ ID NO: 3984).

Another embodiment described herein is an isolated polynucleotide sequence encoding a mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence. In one aspect, the encoded mutant LbCas12a polypeptide has 95% to 99% identity to a polypeptide sequence selected from the even numbered sequences of SEQ ID NO: 4-4022. In another aspect, the encoded mutant LbCas12a polypeptide has a polypeptide sequence selected from the even numbered sequences of SEQ ID NO: 4-4022. In another aspect, the mutant LbCas12a polynucleotide sequence has 95% to 99% identity to a nucleotide sequence selected from the odd numbered sequences of SEQ ID NO: 3-4021. In another aspect, the mutant LbCas12a polynucleotide has a nucleotide sequence selected from the odd numbered sequences of SEQ ID NO: 3-4021. In another aspect, the encoded mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2. In another aspect, the encoded mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D as compared to the wild-type LbCas12a polypeptide sequence of SEQ ID NO: 2. In another aspect, the mutant LbCas12a polynucleotide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960;

E981V, SEQ ID NO: 880; S1020E, SEQ ID NO: 532; V1083W, SEQ ID NO: 132; or K1121D, SEQ ID NO: 598. In another aspect, the encoded mutant LbCas12a polypeptide comprises a substitution mutation selected from: (a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or (b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121. In another aspect, the multiple substitution mutations comprise: E88A/E795Q, E125K/E795Q, G146R/E795Q, R182V/E795Q, V491D/E795Q, Q5291/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, G146R/R182V/E795Q/P799V/T814K, or E125K/G146R/R182V/E795Q/D665N/E981V. In another aspect, the multiple substitution mutations comprise: E88A/E795Q, E125K/E795Q, G146R/E795Q, R182V/E795Q, V491D/E795Q, Q5291/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K, and provide an improvement in CRISPR/LbCas12a-associated nuclease activity at non-canonical TTTT PAM sites as compared to the wild-type LbCas12a polypeptide sequence. In another aspect, the encoded mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q5291/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020). In another aspect, the encoded mutant LbCas12a polypeptide is G146R/R182V/E795Q (SEQ ID NO: 3984). In another aspect, the mutant LbCas12a polynucleotide is selected from SEQ ID NO: 801, 427, 2901, 155, 693, 97, 953, 133, 1729, 641, 719, 1013, 929, 705, 833, 987, 113, 249, 3957, 47, 69, 1959, 879, 531, 597, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, 4019, or 4021. In another aspect, the mutant LbCas12a polynucleotide is selected from SEQ ID NO: 801, 427, 2901, 155, 693, 97, 953, 133, 1729, 1013, 929, 705, 113, 249, 531, 597, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, or 4019, and encodes a mutant LbCas12a polypeptide that provides an improvement in CRISPR/LbCas12a-associated nuclease activity at non-canonical TTTT PAM sites as compared to the wild-type LbCas12a polypeptide sequence. In another aspect, the mutant LbCas12a polynucleotide is SEQ ID NO: 3983.

Another embodiment described herein is a vector or plasmid comprising any of the polynucleotide sequences described herein.

Another embodiment described herein is a cell comprising any of the polynucleotide sequences described herein or the vectors or plasmids described herein.

Another embodiment described herein is an isolated ribonucleoprotein complex comprising a guide RNA and a mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence. In one aspect, the mutant LbCas12a polypeptide has a polypeptide sequence selected from the even numbered sequences of SEQ ID NO: 4-4022. In another aspect, the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2. In another aspect, the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2. In another aspect, the mutant LbCas12a polypeptide is selected from: F81E, SEQ ID NO: 802; E125K, SEQ ID NO: 428;

N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598. In another aspect, the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q5291/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020). In another aspect, the mutant LbCas12a polypeptide is G146R/R182V/E795Q (SEQ ID NO: 3984).

Another embodiment described herein is a method for increasing efficiency of gene editing at non-canonical TTTT PAM sites in a cell with a CRISPR ribonucleoprotein complex, the method comprising contacting a cell with the CRISPR ribonucleoprotein complex that includes a guide RNA and a mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence. In one aspect, the mutant LbCas12a polypeptide has a polypeptide sequence selected from the even numbered sequences of SEQ ID NO: 4-4022. In another aspect, the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2. In another aspect, the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2. In another aspect, the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598. In another aspect, the mutant LbCas12a polypeptide comprises a substitution mutation selected from (a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or (b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121. In another aspect, the multiple substitution mutations comprise: E88A/E795Q, E125K/E795Q, G146R/E795Q, R182V/E795Q, V491D/E795Q, Q5291/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K. In another aspect, the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q5291/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/ E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/ R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/ R182V/E795Q/F81E (SEQ ID NO: 4002), G146R/R182V/ E795Q/E125K (SEQ ID NO: 4004), G146R/R182V/E795Q/ E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/ G146R/R182V/E795Q/D665N (SEQ ID NO: 4018), or G146R/R182V/E795Q/P799V/T814K (SEQ ID NO: 4020). In another aspect, the mutant LbCas12a polypeptide is G146R/R182V/E795Q (SEQ ID NO: 3984).

Another embodiment described herein is a kit for increasing efficiency of gene editing at non-canonical TTTT PAM sites in a cell, the kit comprising a CRISPR ribonucleoprotein complex that includes a guide RNA and a mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence. In one aspect, the mutant LbCas12a polypeptide has a polypeptide sequence selected from the even numbered sequences of SEQ ID NO: 4-4022. In another aspect, the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2. In another aspect, the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wildtype LbCas12a polypeptide sequence of SEQ ID NO: 2. In another aspect, the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598. In another aspect, the mutant LbCas12a polypeptide comprises a substitution mutation selected from (a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or (b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121. In another aspect, the multiple substitution mutations comprise: E88A/E795Q, E125K/E795Q, G146R/E795Q, R182V/E795Q, V491D/ E795Q, Q5291/E795Q, Y646H/E795Q, D665N/E795Q, T814K/E795Q, L839F/E795Q, Q906F/E795Q, E795Q/ Q1170D, G146R/R182V/E795Q, G146R/E795Q/D665N, G146R/E795Q/E981V, G146R/E795Q/T814K, G146R/ R182V/D665N, E125K/R182V/E981V, R182V/P799V/ E981V, R182V/T814K/E981V, G146R/P799V/E981V, G146R/R182V/E795Q/F81E, G146R/R182V/E795Q/ E125K, G146R/R182V/E795Q/E125A, G146R/R182V/ E795Q/P799V, G146R/R182V/E795Q/T814K, G146R/ R182V/E795Q/E981V, G146R/R182V/E795Q/D665N, G146R/R182V/P799V/E981V, E125K/G146R/R182V/ E795Q/D665N, or G146R/R182V/E795Q/P799V/T814K. In another aspect, the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/ E795Q (SEQ ID NO: 3966), V491D/E795Q (SEQ ID NO: 3968), Q5291/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/ Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/ T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/ E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/ R182V/E795Q/P799V (SEQ ID NO: 4008), G146R/R182V/ E795Q/T814K (SEQ ID NO: 4010), G146R/R182V/E795Q/ E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020). In another aspect, the mutant LbCas12a polypeptide is G146R/R182V/E795Q (SEQ ID NO: 3984).

Another embodiment described herein is the use of a mutant LbCas12a polypeptide for improving CRISPR/ LbCas12a-associated nuclease activity at non-canonical TTTT PAM sites, wherein the mutant LbCas12a polypeptide comprises at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence. In one aspect, the mutant LbCas12a polypeptide has a polypeptide sequence selected from the even numbered sequences of SEQ ID NO: 4-4022. In another aspect, the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2. In another aspect, the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2. In another aspect, the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598. In another aspect, the mutant LbCas12a polypeptide comprises a substitution mutation selected from (a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or (b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121. In another aspect, the multiple substitution mutations comprise: E88A/E795Q, E125K/E795Q, G146R/E795Q, R182V/E795Q, V491D/E795Q, Q529I/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K. In another aspect, the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q529I/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020). In another aspect, the mutant LbCas12a polypeptide is G146R/R182V/E795Q (SEQ ID NO: 3984).

Another embodiment described herein is a method for expressing and purifying a mutant LbCas13a protein, the method comprising: (a) inserting a nucleotide sequence encoding a mutant LbCas12a polypeptide comprising at least one amino acid substitution compared to a wild-type LbCas12a polypeptide sequence and having 95-99% identity to any one of the even numbered polypeptide sequences of SEQ ID NO: 4-4022 into an expression plasmid; (b) transforming one or more cells with the expression plasmid; (c) inducing expression of the transformed plasmid; (d) isolating the cells; (e) extracting the mutant LbCas13a protein; and (f) purifying the mutant LbCas13a protein; wherein the mutant LbCas12a polypeptide provides an improvement in CRISPR/LbCas12a-associated nuclease activity at non-canonical TTTT PAM sites as compared to a wild-type LbCas12a polypeptide sequence.

Another embodiment described herein is a mutant LbCas12a polypeptide produced by a method described herein.

DESCRIPTION OF THE DRAWINGS

FIG. 3A shows exemplary phenotype scores of point mutations at position E795 of LbCas12a.

FIG. 5B). The cleavage activity of LbCas12a variants at TTTT PAM site was measured by bacterial-based activity assay. The survival of E. coli under arabinose selection is dependent on the successful cleavage of HPRT38346 protospacer on a toxin-expressing plasmid using TTTT PAM. The survival rate of E. coli dramatically reduced in the absence of HPRT38346 gRNA. See FIG. 5A (wild-type) vs. FIG. 5B (negative control). Compared to wild-type (FIG. 5A), all exemplary mutants increased the survival rate in the presence of gRNA (FIG. 5C-FIG. 5J, mutants: K478R; E898N; S396D; G146R; K595R; E795Q; T814G; and V1083W, respectively), reflecting an enhanced cleavage activity of LbCas12a variants at non-canonical TTTT PAM.

FIG. 6A-B show the performance evaluation of LbCas12a variants in human cells as RNP complexes. LbCas12a variants shown in Table 7 were purified and assembled as RNPs using four different crRNAs (Table 9). FIG. 6A shows the editing efficiency of LbCas12a variants using a T7 endonuclease I assay 48-hours post-delivery to human HEK293 cells. Three replicates were performed. The averaged data and standard deviation are shown in Table 10. FIG. 6B shows the normalized editing efficiency of each variant (normalized to wild-type LbCas12a) and presented as fold-improvement over the wild-type. The first quartile (Q1), median, and third quartile (Q3) are shown for each mutant. The dashed line represents the baseline activity of the wild-type LbCas12a protein. Two replicates were performed. The normalized data is shown in Table 11 for each crRNA.

DETAILED DESCRIPTION

Figure 1A:
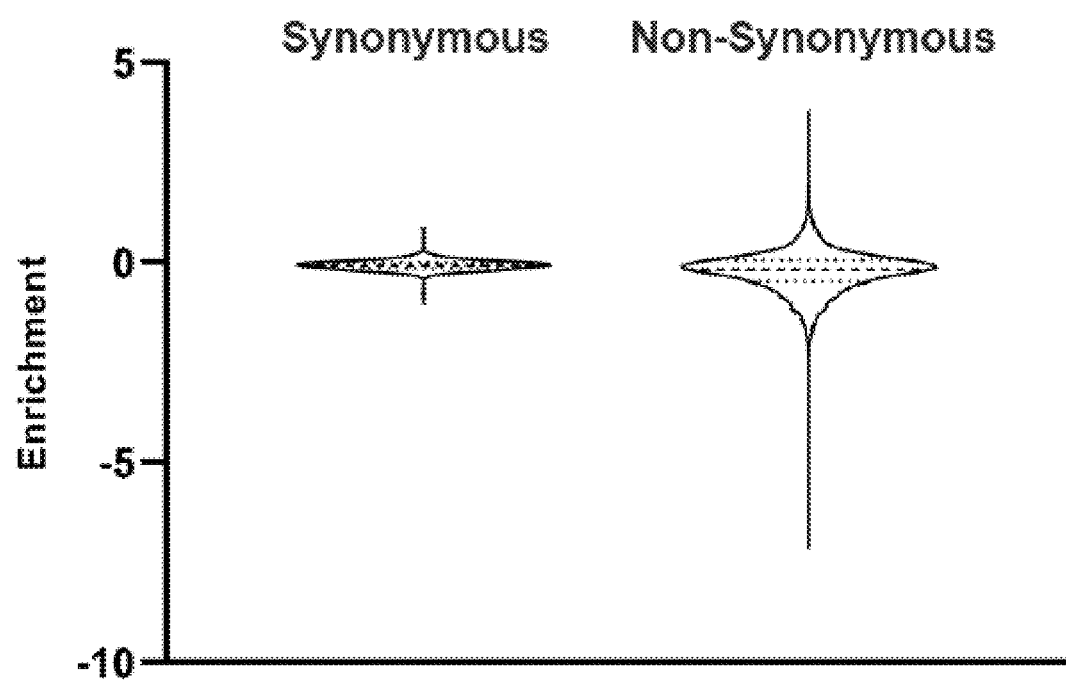
FIG. 1A shows exemplary phenotype distribution of all LbCas12a mutants covered by the bacteria screen. The averaged enrichment scores of point mutations over two biological replicates of selection were used for this analysis. The enrichment score of all synonymous changes (i.e., a different codon encoding the same amino acid as the wild-type amino acid) tightly clustered around 0, which enabled the quantification of phenotype of WT-LbCas12a in the selection.

Unless otherwise defined, all technical and scientific terms used herein have the same meaning as commonly understood by one of ordinary skill in the art. For example, any nomenclatures used in connection with, and techniques of, cell and tissue culture, molecular biology, immunology, microbiology, genetics, and protein and nucleic acid chemistry and hybridization described herein are well known and commonly used in the art. In case of conflict, the present disclosure, including definitions, will control. Exemplary methods and materials are described below, although methods and materials similar or equivalent to those described herein can be used in practice or testing of the present invention.

As used herein, the terms "amino acid," "nucleotide," "polypeptide," "polynucleotide," and "vector" have their common meanings as would be understood by a biochemist of ordinary skill in the art. Standard single letter nucleotides (A, C, G, T, U) and standard single letter amino acids (A, C, D, E, F, G, H, I, K, L, M, N, P, Q, R, S, T, V, W, or R) are used herein.

As used herein, the terms such as "include," "including," "contain," "containing," "having," and the like mean "comprising." The disclosure also contemplates other embodiments "comprising," "consisting of," and "consisting essentially of," the embodiments, aspects, or elements presented herein, whether explicitly set forth or not.

As used herein, the term "a," "an," "the" and similar terms used in the context of the disclosure (especially in the context of the claims) are to be construed to cover both the singular and plural unless otherwise indicated herein or clearly contradicted by the context. In addition, "a," "an," or "the" means "one or more" unless otherwise specified.

As used herein, the term "or" can be conjunctive or disjunctive.

As used herein, the term "substantially" means to a great or significant extent, but not completely.

As used herein, the term "about" or "approximately" as applied to one or more values of interest, refers to a value that is similar to a stated reference value, or within an acceptable error range for the particular value as determined by one of ordinary skill in the art, which will depend in part on how the value is measured or determined, such as the limitations of the measurement system. In one aspect, the term "about" refers to any values, including both integers and fractional components that are within a variation of up to ±10% of the value modified by the term "about." Alternatively, "about" can mean within 3 or more standard deviations, per the practice in the art. Alternatively, such as with respect to biological systems or processes, the term "about" can mean within an order of magnitude, in some embodiments within 5-fold, and in some embodiments within 2-fold, of a value. As used herein, the symbol "~" means "about" or "approximately."

All ranges disclosed herein include both end points as discrete values as well as all integers and fractions specified within the range. For example, a range of 0.1-2.0 includes 0.1, 0.2, 0.3, 0.4 . . . 2.0. If the end points are modified by the term "about," the range specified is expanded by a variation of up to ±10% of any value within the range or within 3 or more standard deviations, including the end points.

As used herein, the terms "control," or "reference" are used herein interchangeably. A "reference" or "control" level may be a predetermined value or range, which is employed as a baseline or benchmark against which to assess a measured result. "Control" also refers to control experiments or control cells.

As used herein, the phrase "an effective amount" of a compound described herein refers to an amount of the compound described herein that will elicit the biological response, for example, reduction or inhibition of an enzyme or a protein activity, or ameliorate symptoms, alleviate conditions, slow or delay disease progression, or prevent a disease, etc.

As used herein, the terms "inhibit," "inhibition," or "inhibiting" refer to the reduction or suppression of a given condition, symptom, or disorder, or disease, or a significant decrease in the baseline activity of a biological activity or process.

As used herein, the terms "Lachnospiraceae bacterium Cas12a" or "LbCas12a" are used interchangeably and refer to the Lachnospiraceae bacterium ND2006 (Lb) Cas12a protein (previously named Cpf1), a class 2/type V CRISPR RNA-guided endonuclease.

The terms "LbCas12a," "wild-type LbCas12a," "wild-type Lb enzyme," or "WT LbCas12a" refer to a protein having the amino acid sequence of the naturally-occurring Lachnospiraceae bacterium ND2006 Cas12a (e.g., SEQ ID NO: 2, encoded by the nucleotide sequence of SEQ ID NO:

1) and that has biochemical activity when combined with a suitable crRNA to form an active CRISPR/Cas12a endonuclease system.

The term "mutant LbCas12a protein" or "variant LbCas12a protein" are used interchangeably and refer to LbCas12a protein forms having a different amino acid sequence form the wild-type Lachnospiraceae bacterium ND2006 Cas12a and that have biochemical activity when combined with a suitable crRNA to form an active CRISPR-Cas12a endonuclease system. This includes orthologs and Cas12a variants having different amino acid sequences from the wild-type Lachnospiraceae bacterium ND2006 Cas12a. The mutant LbCas12a proteins described herein have at least one amino acid substitution to the wild-type LbCas12a polypeptide sequence. In one aspect, the mutant LbCas12a polypeptides have at least one amino acid substitution to the wild-type LbCas12a polypeptide sequence and have an improvement in CRISPR/LbCas12a-associated nuclease activity at non-canonical TTTT PAM sites as compared to the wild-type LbCas12a enzyme.

As used herein, the phrase "the odd numbered sequences of SEQ ID NO: 3-4021" refers to nucleotide sequences of SEQ ID NO: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1289, 1291, 1293, 1295, 1297, 1299, 1301, 1303, 1305, 1307, 1309, 1311, 1313, 1315, 1317, 1319, 1321, 1323, 1325, 1327, 1329, 1331, 1333, 1335, 1337, 1339, 1341, 1343, 1345, 1347, 1349, 1351, 1353, 1355, 1357, 1359, 1361, 1363, 1365, 1367, 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549, 1551, 1553, 1555, 1557, 1559, 1561, 1563, 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615, 1617, 1619, 1621, 1623, 1625, 1627, 1629, 1631, 1633, 1635, 1637, 1639, 1641, 1643, 1645, 1647, 1649, 1651, 1653, 1655, 1657, 1659, 1661, 1663, 1665, 1667, 1669, 1671, 1673, 1675, 1677, 1679, 1681, 1683, 1685, 1687, 1689, 1691, 1693, 1695, 1697, 1699, 1701, 1703, 1705, 1707, 1709, 1711, 1713, 1715, 1717, 1719, 1721, 1723, 1725, 1727, 1729, 1731, 1733, 1735, 1737, 1739, 1741, 1743, 1745, 1747, 1749, 1751, 1753, 1755, 1757, 1759, 1761, 1763, 1765, 1767, 1769, 1771, 1773, 1775, 1777, 1779, 1781, 1783, 1785, 1787, 1789, 1791, 1793, 1795, 1797, 1799, 1801, 1803, 1805, 1807, 1809, 1811, 1813, 1815, 1817, 1819, 1821, 1823, 1825, 1827, 1829, 1831, 1833, 1835, 1837, 1839, 1841, 1843, 1845, 1847, 1849, 1851, 1853, 1855, 1857, 1859, 1861, 1863, 1865, 1867, 1869, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, 2135, 2137, 2139, 2141, 2143, 2145, 2147, 2149, 2151, 2153, 2155, 2157, 2159, 2161, 2163, 2165, 2167, 2169, 2171, 2173, 2175, 2177, 2179, 2181, 2183, 2185, 2187, 2189, 2191, 2193, 2195, 2197, 2199, 2201, 2203, 2205, 2207, 2209, 2211, 2213, 2215, 2217, 2219, 2221, 2223, 2225, 2227, 2229, 2231, 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, 2357, 2359, 2361, 2363, 2365, 2367, 2369, 2371, 2373, 2375, 2377, 2379, 2381, 2383, 2385, 2387, 2389, 2391, 2393, 2395, 2397, 2399, 2401, 2403, 2405, 2407, 2409, 2411, 2413, 2415, 2417, 2419, 2421, 2423, 2425, 2427, 2429, 2431, 2433, 2435, 2437, 2439, 2441, 2443, 2445, 2447, 2449, 2451, 2453, 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2499, 2501, 2503, 2505, 2507, 2509, 2511, 2513, 2515, 2517, 2519, 2521, 2523, 2525, 2527, 2529, 2531, 2533, 2535, 2537, 2539, 2541, 2543, 2545, 2547, 2549, 2551, 2553, 2555, 2557, 2559, 2561, 2563, 2565, 2567, 2569, 2571, 2573, 2575, 2577, 2579, 2581, 2583, 2585, 2587, 2589, 2591, 2593, 2595, 2597, 2599, 2601, 2603, 2605, 2607, 2609, 2611, 2613, 2615, 2617, 2619, 2621, 2623, 2625, 2627, 2629, 2631, 2633, 2635, 2637, 2639, 2641, 2643, 2645, 2647, 2649, 2651, 2653, 2655, 2657, 2659, 2661, 2663, 2665, 2667, 2669, 2671, 2673, 2675, 2677, 2679, 2681, 2683, 2685, 2687, 2689, 2691, 2693, 2695, 2697, 2699, 2701, 2703, 2705, 2707, 2709, 2711, 2713, 2715, 2717, 2719, 2721, 2723, 2725, 2727, 2729, 2731, 2733, 2735, 2737, 2739, 2741, 2743, 2745, 2747, 2749, 2751, 2753, 2755, 2757, 2759, 2761, 2763, 2765, 2767, 2769, 2771, 2773, 2775, 2777, 2779, 2781, 2783, 2785, 2787, 2789, 2791, 2793, 2795, 2797, 2799, 2801, 2803, 2805, 2807, 2809, 2811, 2813, 2815, 2817, 2819, 2821, 2823, 2825, 2827, 2829, 2831, 2833, 2835, 2837, 2839, 2841, 2843, 2845, 2847, 2849, 2851, 2853, 2855, 2857, 2859, 2861, 2863, 2865, 2867, 2869, 2871, 2873, 2875, 2877, 2879, 2881, 2883, 2885, 2887, 2889, 2891, 2893, 2895, 2897, 2899, 2901, 2903, 2905, 2907, 2909, 2911, 2913, 2915, 2917, 2919, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, 2969, 2971, 2973, 2975, 2977, 2979, 2981, 2983, 2985, 2987, 2989, 2991, 2993, 2995, 2997, 2999, 3001, 3003, 3005, 3007, 3009, 3011, 3013, 3015, 3017, 3019, 3021, 3023, 3025, 3027, 3029, 3031, 3033, 3035, 3037, 3039, 3041, 3043, 3045, 3047, 3049, 3051, 3053, 3055, 3057, 3059, 3061, 3063, 3065, 3067, 3069, 3071, 3073, 3075, 3077, 3079, 3081, 3083, 3085, 3087, 3089, 3091, 3093, 3095, 3097, 3099, 3101, 3103, 3105, 3107, 3109, 3111, 3113, 3115, 3117, 3119, 3121, 3123, 3125, 3127, 3129, 3131, 3133, 3135, 3137, 3139, 3141, 3143, 3145, 3147, 3149, 3151, 3153, 3155, 3157, 3159, 3161, 3163, 3165, 3167, 3169, 3171, 3173, 3175, 3177, 3179, 3181, 3183, 3185, 3187, 3189, 3191, 3193, 3195, 3197, 3199, 3201, 3203, 3205, 3207, 3209, 3211, 3213, 3215, 3217, 3219, 3221, 3223, 3225, 3227, 3229, 3231, 3233, 3235, 3237, 3239, 3241, 3243, 3245, 3247, 3249, 3251, 3253, 3255, 3257, 3259, 3261, 3263, 3265, 3267, 3269, 3271, 3273, 3275, 3277, 3279, 3281, 3283, 3285, 3287, 3289, 3291, 3293, 3295, 3297, 3299, 3301, 3303, 3305, 3307, 3309, 3311, 3313, 3315, 3317, 3319, 3321, 3323, 3325, 3327, 3329, 3331, 3333, 3335, 3337, 3339, 3341, 3343, 3345, 3347, 3349, 3351, 3353, 3355, 3357, 3359, 3361, 3363, 3365, 3367, 3369, 3371, 3373, 3375, 3377, 3379, 3381, 3383, 3385, 3387, 3389, 3391, 3393, 3395, 3397, 3399, 3401, 3403, 3405, 3407, 3409, 3411, 3413, 3415, 3417, 3419, 3421, 3423, 3425, 3427, 3429, 3431, 3433, 3435, 3437, 3439, 3441, 3443, 3445, 3447, 3449, 3451, 3453, 3455, 3457, 3459, 3461, 3463, 3465, 3467, 3469, 3471, 3473, 3475, 3477, 3479, 3481, 3483, 3485, 3487, 3489, 3491, 3493, 3495, 3497, 3499, 3501, 3503, 3505, 3507, 3509, 3511, 3513, 3515, 3517, 3519, 3521, 3523, 3525, 3527, 3529, 3531, 3533, 3535, 3537, 3539, 3541, 3543, 3545, 3547, 3549, 3551, 3553, 3555, 3557, 3559, 3561, 3563, 3565, 3567, 3569, 3571, 3573, 3575, 3577, 3579, 3581, 3583, 3585, 3587, 3589, 3591, 3593, 3595, 3597, 3599, 3601, 3603, 3605, 3607, 3609, 3611, 3613, 3615, 3617, 3619, 3621, 3623, 3625, 3627, 3629, 3631, 3633, 3635, 3637, 3639, 3641, 3643, 3645, 3647, 3649, 3651, 3653, 3655, 3657, 3659, 3661, 3663, 3665, 3667, 3669, 3671, 3673, 3675, 3677, 3679, 3681, 3683, 3685, 3687, 3689, 3691, 3693, 3695, 3697, 3699, 3701, 3703, 3705, 3707, 3709, 3711, 3713, 3715, 3717, 3719, 3721, 3723, 3725, 3727, 3729, 3731, 3733, 3735, 3737, 3739, 3741, 3743, 3745, 3747, 3749, 3751, 3753, 3755, 3757, 3759, 3761, 3763, 3765, 3767, 3769, 3771, 3773, 3775, 3777, 3779, 3781, 3783, 3785, 3787, 3789, 3791, 3793, 3795, 3797, 3799, 3801, 3803, 3805, 3807, 3809, 3811, 3813, 3815, 3817, 3819, 3821, 3823, 3825, 3827, 3829, 3831, 3833, 3835, 3837, 3839, 3841, 3843, 3845, 3847, 3849, 3851, 3853, 3855, 3857, 3859, 3861, 3863, 3865, 3867, 3869, 3871, 3873, 3875, 3877, 3879, 3881, 3883, 3885, 3887, 3889, 3891, 3893, 3895, 3897, 3899, 3901, 3903, 3905, 3907, 3909, 3911, 3913, 3915, 3917, 3919, 3921, 3923, 3925, 3927, 3929, 3931, 3933, 3935, 3937, 3939, 3941, 3943, 3945, 3947, 3949, 3951, 3953, 3955, 3957, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, 4019, or 4021.

As used herein, the phrase "the even numbered sequences of SEQ ID NO: 4-4022" refers to polypeptide sequences of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, 1288, 1290, 1292, 1294, 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, 1566, 1568, 1570, 1572, 1574, 1576, 1578, 1580, 1582, 1584, 1586, 1588, 1590, 1592, 1594, 1596, 1598, 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, 1772, 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, 1820, 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, 2136, 2138, 2140, 2142, 2144, 2146, 2148, 2150, 2152, 2154, 2156, 2158, 2160, 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346, 2348, 2350, 2352, 2354, 2356, 2358, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, 2502, 2504, 2506, 2508, 2510, 2512, 2514, 2516, 2518, 2520, 2522, 2524, 2526, 2528, 2530, 2532, 2534, 2536, 2538, 2540, 2542, 2544, 2546, 2548, 2550, 2552, 2554, 2556, 2558, 2560, 2562, 2564, 2566, 2568, 2570, 2572, 2574, 2576, 2578, 2580, 2582, 2584, 2586, 2588, 2590, 2592, 2594, 2596, 2598, 2600, 2602, 2604, 2606, 2608, 2610, 2612, 2614, 2616, 2618, 2620, 2622, 2624, 2626, 2628, 2630, 2632, 2634, 2636, 2638, 2640, 2642, 2644, 2646, 2648, 2650, 2652, 2654, 2656, 2658, 2660, 2662, 2664, 2666, 2668, 2670, 2672, 2674, 2676, 2678, 2680, 2682, 2684, 2686, 2688, 2690, 2692, 2694, 2696, 2698, 2700, 2702, 2704, 2706, 2708, 2710, 2712, 2714, 2716, 2718, 2720, 2722, 2724, 2726, 2728, 2730, 2732, 2734, 2736, 2738, 2740, 2742, 2744, 2746, 2748, 2750, 2752, 2754, 2756, 2758, 2760, 2762, 2764, 2766, 2768, 2770, 2772, 2774, 2776, 2778, 2780, 2782, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, 2836, 2838, 2840, 2842, 2844, 2846, 2848, 2850, 2852, 2854, 2856, 2858, 2860, 2862, 2864, 2866, 2868, 2870, 2872, 2874, 2876, 2878, 2880, 2882, 2884, 2886, 2888, 2890, 2892, 2894, 2896, 2898, 2900, 2902, 2904, 2906, 2908, 2910, 2912, 2914, 2916, 2918, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964, 2966, 2968, 2970, 2972, 2974, 2976, 2978, 2980, 2982, 2984, 2986, 2988, 2990, 2992, 2994, 2996, 2998, 3000, 3002, 3004, 3006, 3008, 3010, 3012, 3014, 3016, 3018, 3020, 3022, 3024, 3026, 3028, 3030, 3032, 3034, 3036, 3038, 3040, 3042, 3044, 3046, 3048, 3050, 3052, 3054, 3056, 3058, 3060, 3062, 3064, 3066, 3068, 3070, 3072, 3074, 3076, 3078, 3080, 3082, 3084, 3086, 3088, 3090, 3092, 3094, 3096, 3098, 3100, 3102, 3104, 3106, 3108, 3110, 3112, 3114, 3116, 3118, 3120, 3122, 3124, 3126, 3128, 3130, 3132, 3134, 3136, 3138, 3140, 3142, 3144, 3146, 3148, 3150, 3152, 3154, 3156, 3158, 3160, 3162, 3164, 3166, 3168, 3170, 3172, 3174, 3176, 3178, 3180, 3182, 3184, 3186, 3188, 3190, 3192, 3194, 3196, 3198, 3200, 3202, 3204, 3206, 3208, 3210, 3212, 3214, 3216, 3218, 3220, 3222, 3224, 3226, 3228, 3230, 3232, 3234, 3236, 3238, 3240, 3242, 3244, 3246, 3248, 3250, 3252, 3254, 3256, 3258, 3260, 3262, 3264, 3266, 3268, 3270, 3272, 3274, 3276, 3278, 3280, 3282, 3284, 3286, 3288, 3290, 3292, 3294, 3296, 3298, 3300, 3302, 3304, 3306, 3308, 3310, 3312, 3314, 3316, 3318, 3320, 3322, 3324, 3326, 3328, 3330, 3332, 3334, 3336, 3338, 3340, 3342, 3344, 3346, 3348, 3350, 3352, 3354, 3356, 3358, 3360, 3362, 3364, 3366, 3368, 3370, 3372, 3374, 3376, 3378, 3380, 3382, 3384, 3386, 3388, 3390, 3392, 3394, 3396, 3398, 3400, 3402, 3404, 3406, 3408, 3410, 3412, 3414, 3416, 3418, 3420, 3422, 3424, 3426, 3428, 3430, 3432, 3434, 3436, 3438, 3440, 3442, 3444, 3446, 3448, 3450, 3452, 3454, 3456, 3458, 3460, 3462, 3464, 3466, 3468, 3470, 3472, 3474, 3476, 3478, 3480, 3482, 3484, 3486, 3488, 3490, 3492, 3494, 3496, 3498, 3500, 3502, 3504, 3506, 3508, 3510, 3512, 3514, 3516, 3518, 3520, 3522, 3524, 3526, 3528, 3530, 3532, 3534, 3536, 3538, 3540, 3542, 3544, 3546, 3548, 3550, 3552, 3554, 3556, 3558, 3560, 3562, 3564, 3566, 3568, 3570, 3572, 3574, 3576, 3578, 3580, 3582, 3584, 3586, 3588, 3590, 3592, 3594, 3596, 3598, 3600, 3602, 3604, 3606, 3608, 3610, 3612, 3614, 3616, 3618, 3620, 3622, 3624, 3626, 3628, 3630, 3632, 3634, 3636, 3638, 3640, 3642, 3644, 3646, 3648, 3650, 3652, 3654, 3656, 3658, 3660, 3662, 3664, 3666, 3668, 3670, 3672, 3674, 3676, 3678, 3680, 3682, 3684, 3686, 3688, 3690, 3692, 3694, 3696, 3698, 3700, 3702, 3704, 3706, 3708, 3710, 3712, 3714, 3716, 3718, 3720, 3722, 3724, 3726, 3728, 3730, 3732, 3734, 3736, 3738, 3740, 3742, 3744, 3746, 3748, 3750, 3752, 3754, 3756, 3758, 3760, 3762, 3764, 3766, 3768, 3770, 3772, 3774, 3776, 3778, 3780, 3782, 3784, 3786, 3788, 3790, 3792, 3794, 3796, 3798, 3800, 3802, 3804, 3806, 3808, 3810, 3812, 3814, 3816, 3818, 3820, 3822, 3824, 3826, 3828, 3830, 3832, 3834, 3836, 3838, 3840, 3842, 3844, 3846, 3848, 3850, 3852, 3854, 3856, 3858, 3860, 3862, 3864, 3866, 3868, 3870, 3872, 3874, 3876, 3878, 3880, 3882, 3884, 3886, 3888, 3890, 3892, 3894, 3896, 3898, 3900, 3902, 3904, 3906, 3908, 3910, 3912, 3914, 3916, 3918, 3920, 3922, 3924, 3926, 3928, 3930, 3932, 3934, 3936, 3938, 3940, 3942, 3944, 3946, 3948, 3950, 3952, 3954, 3956, 3958, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, or 4022.

Described herein are nucleic acids encoding mutant LbCas12a polypeptides with enhanced editing activity at non-canonical TTTT protospacer adjacent motifs (PAM) compared to the wild-type LbCas12a enzyme.

Cas12a provides a useful complement to Cas9 by expanding the range of PAM sequences that can be targeted from GC-Rich areas (Cas9) to AT-rich areas of the genome (Cas12a), thereby expanding the range of sequences that can be modified using CRISPR genome engineering methods. In addition to having a T-rich PAM site, another advantage of the Cas12a system as compared with Cas9 is the use of a single short RNA molecule.

Described herein are isolated mutant Cas12a proteins comprising at least one point mutation to the wild-type Cas12a amino acid sequence. The isolated mutant Cas12a proteins are active in Clustered Regularly Interspaced Short Palindromic Repeats (CRISPR)/CRISPR-associated protein endonuclease system ("CRISPR/Cas12a endonuclease system"). The CRISPR/Cas12a endonuclease system displays maintained on-target editing activity relative to a wild-type CRISPR/Cas endonuclease system. In one aspect, the Cas12a protein is from Lachnospiraceae bacterium ND2006 (Lb). The wild-type LbCas12a protein (SEQ ID NO: 2) is encoded by the nucleotide sequence (SEQ ID NO: 1) shown below.

Wild-type LbCas12a DNA Sequence
(SEQ ID NO: 1; 3684 nt)
ATGAGCAAACTGGAAAAGTTCACCAACTGTTATAGCCT

GAGCAAAACCCTGCGTTTTAAAGCAATTCCGGTTGGTA

AAACCCAAGAGAACATTGATAATAAACGCCTGCTGGTC

GAAGATGAAAAACGCGCTGAAGATTATAAAGGCGTGAA

AAAACTGCTGGATCGCTATTATCTGAGCTTCATTAACG

ATGTGCTGCACAGCATTAAACTGAAGAACCTGAACAAC

TATATCAGCCTGTTTCGTAAAAAAACCCGCACCGAAAA

AGAAAACAAAGAGCTGGAAAACCTGGAAATCAATCTGC

GTAAAGAAATCGCCAAAGCGTTTAAAGGTAACGAGGGT

TATAAAAGCCTGTTCAAGAAAGACATCATCGAAACCAT

TCTGCCGGAATTTCTGGATGATAAAGATGAAATTGCCC

TGGTGAATAGCTTTAATGGCTTTACCACCGCATTTACC

GGCTTTTTTGATAATCGCGAAAACATGTTCAGCGAAGA

AGCAAAAAGCACCAGCATTGCATTTCGCTGCATTAATG

AAAATCTGACCCGCTACATTAGCAACATGGATATCTTT

GAAAAAGTGGACGCGATCTTCGATAAACACGAAGTGCA

AGAGATCAAAGAGAAAATCCTGAACAGCGATTATGACG

TCGAAGATTTTTTTGAAGGCGAGTTCTTTAACTTCGTT

CTGACCCAAGAAGGTATCGACGTTTATAACGCAATTAT

TGGTGGTTTTGTTACCGAAAGCGGTGAGAAAATCAAAG

GCCTGAATGAATATATCAACCTGTATAACCAGAAAACC

AAACAGAAACTGCCGAAATTCAAACCGCTGTATAAACA

GGTTCTGAGCGATCGTGAAAGCCTGAGCTTTTATGGTG

AAGGTTATACCAGTGATGAAGAGGTTCTGGAAGTTTTT

CGTAACACCCTGAATAAAAACAGCGAGATCTTTAGCAG

CATCAAAAAGCTTGAGAAACTGTTCAAAAACTTTGATG

AGTATAGCAGCGCAGGCATCTTTGTTAAAAATGGTCCG

GCAATTAGCACCATCAGCAAAGATATTTTTGGCGAATG

GAATGTGATCCGCGATAAATGGAATGCCGAATATGATG

ATATCCACCTGAAAAAAAAGGCCGTGGTGACCGAGAAA

TATGAAGATGATCGTCGTAAAAGCTTCAAGAAAATTGG

TAGCTTTAGCCTGGAACAGCTGCAAGAATATGCAGATG

CAGATCTGAGCGTTGTGGAAAAACTGAAAGAAATCATC

ATTCAGAAGGTGGACGAGATCTATAAAGTTTATGGTAG

CAGCGAAAAACTGTTCGATGCAGATTTTGTTCTGGAAA

AAAGCCTGAAAAGAATGATGCCGTTGTGGCCATTATG

AAAGATCTGCTGGATAGCGTTAAGAGCTTCGAGAATTA

CATCAAAGCCTTTTTTGGTGAGGGCAAAGAAACCAATC

GTGATGAAAGTTTCTATGGCGATTTTGTGCTGGCCTAT

GATATTCTGCTGAAAGTGGACCATATTTATGATGCCAT

-continued

```
TCGCAATTATGTTACCCAGAAACCGTATAGCAAAGACA
AGTTCAAACTGTACTTTCAGAACCCGCAGTTTATGGGT
GGTTGGGATAAAGATAAAGAAACCGATTATCGTGCCAC
CATCCTGCGTTATGGTAGTAAATACTATCTGGCCATCA
TGGACAAAAAATACGCAAAATGCCTGCAGAAAATCGAC
AAAGATGATGTGAATGGCAACTATGAAAAAATCAACTA
CAAACTGCTGCCTGGTCCGAATAAAATGCTGCCGAAAG
TGTTCTTTAGCAAGAAATGGATGGCCTATTATAACCCG
AGCGAGGATATTCAAAAGATCTACAAAAATGGCACCTT
TAAAAAGGGCGACATGTTCAATCTGAACGATTGCCACA
AACTGATCGATTTCTTCAAAGATTCAATTTCGCGTTAT
CCGAAATGGTCCAATGCCTATGATTTTAACTTTAGCGA
AACCGAAAAATACAAAGACATTGCCGGTTTTTATCGCG
AAGTGGAAGAACAGGGCTATAAAGTGAGCTTTGAAAGC
GCAAGCAAAAAGAGGTTGATAAGCTGGTTGAAGAGGG
CAAACTGTATATGTTCCAGATTTACAACAAAGATTTTA
GCGACAAAAGCCATGGCACCCCGAATCTGCATACCATG
TACTTTAAACTGCTGTTCGACGAAAATAACCATGGTCA
GATTCGTCTGAGCGGTGGTGCCGAACTGTTTATGCGTC
GTGCAAGTCTGAAAAAGAAGAACTGGTTGTTCATCCG
GCAAATAGCCCGATTGCAAACAAAAATCCGGACAATCC
GAAAAAAACCACGACACTGAGCTATGATGTGTATAAAG
ACAAACGTTTTAGCGAGGATCAGTATGAACTGCATATC
CCGATTGCCATCAATAAATGCCCGAAAAACATCTTTAA
GATCAACACCGAAGTTCGCGTGCTGCTGAAACATGATG
ATAATCCGTATGTGATTGGCATTGATCGTGGTGAACGT
AACCTGCTGTATATTGTTGTTGATGGTAAAGGCAA
CATCGTGGAACAGTATAGTCTGAACGAAATTATCAACA
ACTTTAACGGCATCCGCATCAAAACCGACTATCATAGC
CTGCTGGACAAGAAAGAAAAAGAACGTTTTGAAGCACG
TCAGAACTGGACCAGTATTGAAAACATCAAGAACTGA
AAGCCGGTTATATTAGCCAGGTGGTTCATAAAATCTGT
GAGCTGGTAGAAAAATACGATGCAGTTATTGCACTGGA
AGATCTGAATAGCGGTTTCAAAAATAGCCGTGTGAAAG
TCGAAAAACAGGTGTATCAGAAATTCGAGAAATGCTG
ATCGACAAACTGAACTACATGGTCGACAAAAAAGCAA
TCCGTGTGCAACCGGTGGTGCACTGAAAGGTTATCAGA
TTACCAACAAATTTGAAAGCTTTAAAAGCATGAGCACC
CAGAACGGCTTTATCTTCTATATTCCGGCATGGCTGAC
CAGCAAAATTGATCCGAGCACCGGTTTTGTGAACCTGC
```

-continued

```
TGAAAACAAAATATACCTCCATTGCCGACAGCAAGAAG
TTTATTAGCAGCTTTGATCGCATTATGTATGTTCCGGA
AGAGGACCTGTTTGAATTCGCACTGGATTACAAAATT
TCAGCCGTACCGATGCCGACTACATCAAAAAATGGAAA
CTGTACAGCTATGGTAACCGCATTCGCATTTTTCGCAA
CCCGAAGAAAAACAATGTGTTCGATTGGGAAGAAGTTT
GTCTGACCAGCGCATATAAAGAACTTTTCAACAAATAC
GGCATCAACTATCAGCAGGGTGATATTCGTGCACTGCT
GTGTGAACAGAGCGATAAAGCGTTTTATAGCAGTTTTA
TGGCACTGATGAGCCTGATGCTGCAGATGCGTAATAGC
ATTACCGGTCGCACCGATGTGGATTTTCTGATTAGTCC
GGTGAAAAATTCCGATGGCATCTTTTATGATAGCCGCA
ATTACGAAGCACAAGAAAATGCAATTCTGCCGAAAAAC
GCAGATGCAAATGGTGCATATAACATTGCACGTAAAGT
TCTGTGGGCAATTGGCCAGTTTAAGAAAGCAGAAGATG
AGAAGCTGGACAAAGTGAAAATTGCGATCAGCAATAAA
GAGTGGCTGGAATACGCACAGACCAGCGTTAAACAT
```

WT LbCas12a Amino Acid Sequence
(SEQ ID NO: 2; 1228 AA)

```
MSKLEKFTNCYSLSKTLRFKAIPVGKTQENIDNKRLLV
EDEKRAEDYKGVKKLLDRYYLSFINDVLHSIKLKNLNN
YISLFRKKTRTEKENKELENLEINLRKEIAKAFKGNEG
YKSLFKKDIIETILPEFLDDKDEIALVNSENGETTAFT
GFEDNRENMESEEAKSTSIAFRCINENLTRYISNMDIF
EKVDAIFDKHEVQEIKEKILNSDYDVEDFFEGEFFNEV
LTQEGIDVYNAIIGGFVTESGEKIKGLNEYINLYNQKT
KQKLPKFKPLYKQVLSDRESLSFYGEGYTSDEEVLEVF
RNTLNKNSEIFSSIKKLEKLFKNFDEYSSAGIFVKNGP
AISTISKDIFGEWNVIRDKWNAEYDDIHLKKKAVVTEK
YEDDRRKSFKKIGSFSLEQLQEYADADLSVVEKLKEII
IQKVDEIYKVYGSSEKLFDADFVLEKSLKKNDAVVAIM
KDLLDSVKSFENYIKAFFGEGKETNRDESFYGDFVLAY
DILLKVDHIYDAIRNYVTQKPYSKDKFKLYFQNPQFMG
GWDKDKETDYRATILRYGSKYYLAIMDKKYAKCLQKID
KDDVNGNYEKINYKLLPGPNKMLPKVFFSKKWMAYYNP
SEDIQKIYKNGTFKKGDMFNLNDCHKLIDFFKDSISRY
PKWSNAYDENFSETEKYKDIAGFYREVEEQGYKVSFES
ASKKEVDKLVEEGKLYMFQIYNKDFSDKSHGTPNLHTM
YFKLLFDENNHGQIRLSGGAELFMRRASLKKEELVVHP
ANSPIANKNPDNPKKTTTLSYDVYKDKRFSEDQYELHI
PIAINKCPKNIFKINTEVRVLLKHDDNPYVIGIDRGER
NLLYIVVVDGKGNIVEQYSLNEIINNENGIRIKTDYHS
```

-continued

LLDKKEKERFEARQNWTSIENIKELKAGYISQVVHKIC

ELVEKYDAVIALEDLNSGFKNSRVKVEKQVYQKFEKML

IDKLNYMVDKKSNPCATGGALKGYQITNKFESFKSMST

QNGFIFYIPAWLTSKIDPSTGFVNLLKTKYTSIADSKK

FISSFDRIMYVPEEDLFEFALDYKNFSRTDADYIKKWK

LYSYGNRIRIFRNPKKNNVFDWEEVCLTSAYKELFNKY

GINYQQGDIRALLCEQSDKAFYSSFMALMSLMLQMRNS

ITGRTDVDFLISPVKNSDGIFYDSRNYEAQENAILPKN

ADANGAYNIARKVLWAIGQFKKAEDEKLDKVKIAISNK

EWLEYAQTSVKH

Described herein is the phenotype of select point mutations of LbCas12a in the bacterial screening of the DNA cleavage activity at non-canonical TTTT PAM. A bacterial-based directed evolution of LbCas12a was performed to identify mutations with enhanced cleavage activity. A deep-scanning mutagenesis library was created that contains all possible amino acid point mutations over the entire coding sequence of LbCas12a, with most clones containing only a single mutation. Wrenbeck et al., *Nat. Methods* 13: 928-930 (2016). This type of library allows the direct evaluation of the phenotype of each point mutation by measuring their relative survival rates over the wild-type LbCas12a protein in the bacterial screen.

The screen works by transforming a screening strain harboring a toxin plasmid with the mutant LbCas12a library and crRNA targeting the HPRT38346 site on the toxin plasmid. After recovery and IPTG induction, cells were plated on LB-chloramphenicol media with arabinose and incubated at 37° C. overnight. Functional LbCas12 enzymes are capable of CRISPR activity and deactivate the toxin plasmid. If the mutant LbCas12a enzyme is not functional the transformed screening *E. coli* cells do not survive. LbCas12a expression plasmids carried by the surviving *E. coli* cells were extracted and purified. Both input and selected plasmid libraries were amplified by PCR, randomly fragmented by Nextera library prep kit, and sequenced on Illumina NextSeq™ with ~40 million reads per library. The frequencies of mutations at each position of LbCas12a in both libraries were measured and normalized to the total coverage of each codon. The relative survival rate of each point mutation was calculated as the ratio of normalized frequency between selected and input library. Since the degree of cell survival under the arabinose selection is indicative of the cleavage activity of LbCas12a variant at HPRT38346 protospacer, any variants that enriched during the selection over WT are those with enhanced activity at the TTTT PAM.

Figure 2:
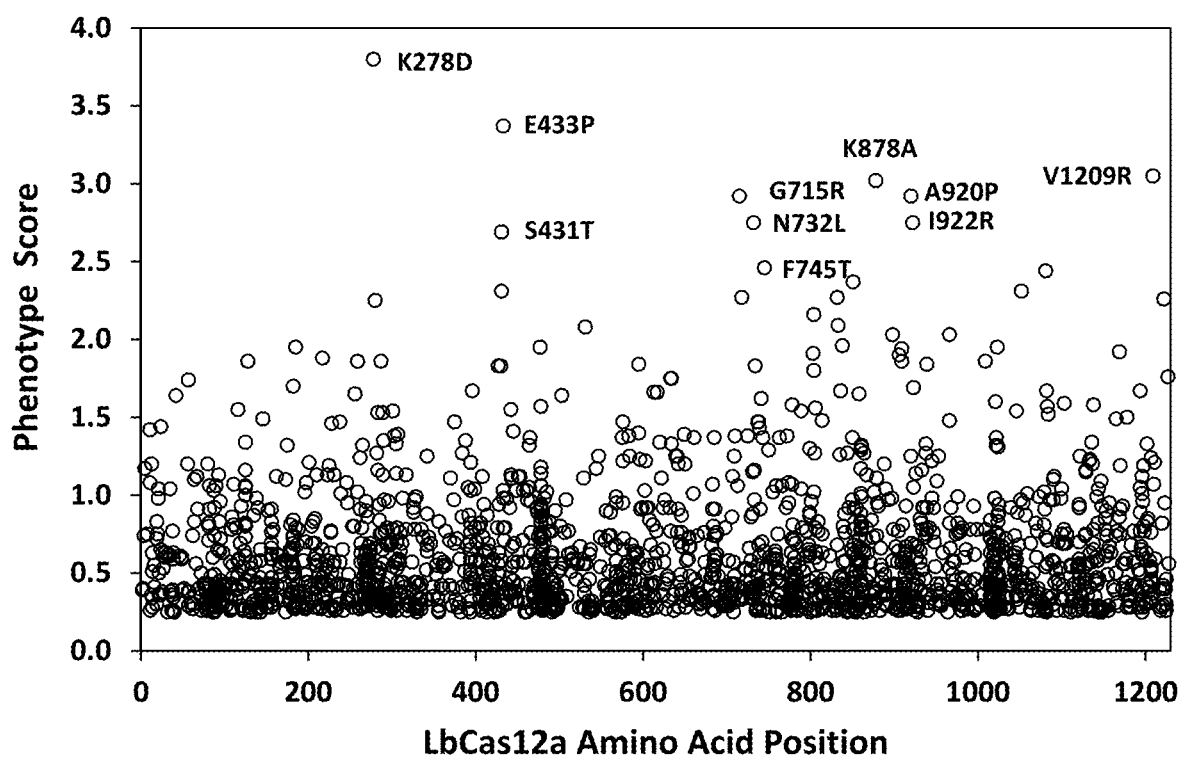
FIG. 2 shows the phenotype (activity) score of all mutations across the LbCas12a polypeptide sequence. The ten most active mutants are indicated.

The phenotype of 17,278 point-mutations of LbCas12a in the bacterial screening measures the cleavage activity at the non-canonical TTTT PAM. Two biological replicates were performed with phenotype measurements, which enabled the isolation of a large collection of novel LbCas12a variants with enhanced cleavage activity. The mutated residues in the library are shown in Table 1; the wild-type mutated amino acids are listed above the wild-type sequence (the actual mutated residues are not shown, e.g., only S2 is shown, not S2H). The specific mutations and activity levels are shown in Table 2. FIG. 2 shows the activity score of the mutations across the wild-type LbCas12a amino acid sequence and the top-ten mutants are indicated. The phenotype score (or activity score) is calculated as the natural logarithm of the ratio of normalized frequency between selected (Round 4) and Input Library (Round 3), where the normalized frequency of each mutant at each position is calculated as the ratio of mutant and synonyms change at each position.

The phenotypes of specific mutations were evaluated in *E. coli* as the colony formation unit (CFU) of each mutant. Those mutants with enhanced CFU upon selection indicated an improved editing efficiency in *E. coli*, regardless of the actual mechanism.

TABLE 1

Mutated LbCas12a Residues

| | | |
|---|---|---|
| 1 | SKLE  T   YLS   T FKA I V KT  N DNR  LVED K    D   G   K    RYYS<br>MSKLEKFTNCYSLSKTLRFKAIPVGKTQENIDNKRLLVEDEKRAEDYKGVKKLLDRYYLS | 60 |
| 61 | IND LHSIK    NNYISLFRKKTRTEKENKELE LEL  R E   KAFKG  GYKS FK<br>FINDVLHSIKLKNLNNYISLFRKKTRTEKENKELENLEINLRKEIAKAFKGNEGYKSLFK | 120 |
| 121 | D IE L EFLD KDEIAL     SFNG   AFT   DNR   FSE AKS    AFRC  ENL<br>KDIIETILPEFLDDKDEIALVNSFNGFITAFTGFFDNRENMFSEEAKSTSIAFRCINENL | 180 |
| 181 | TRYISNMDI   VD IFDKHE  QEIKEKIL SDY VE  FEGEFFNFV TQE I VYNAI<br>TRYISNMDIFEKVDAIFDKHEVQEIKEKILNSDYDVEDFFEGEFFNFVLTQEGIDVYNAI | 240 |
| 241 | G    TES   K  GLN   I LYNQKTK  K PKFK   KQVLSDRESLSFYGEGYTSDEEV<br>IGGFVTESGEKIKGLNEYINLYNQKTKQKLPKFKPLYKQVLSDRESLSFYGEGYTSDEEV | 300 |
| 301 | LEVFRNTLNKNSEI   SI KL  L KNFDE SSAG F   GPI   T   KD   G WNV R<br>LEVFRNTLNKNSEIFSSIKKLEKLFKNFDEYSSAGIFVKNGPAISTISKDIFGEWNVIRD | 360 |
| 361 | KWA        IH KKKAV  TE YED   KS KKIGS S  EQLQ   ADADLSVVEKLKEIII<br>KWNAEYDDIHLKKKAVVTEKYEDDRRKSFKKIGSFSLEQLQEYADADLSVVEKLKEIIIQ | 420 |
| 421 | KVD IYKVYGSSEKLFD  FVLEKSL KNDA V   MKDL DS KSFENYI  FFG GKET<br>KVDEIYKVYGSSEKLFDADFVLEKSLKKNDAVVAIMKDLLDSVKSFENYIKAFFGEGKET | 480 |

TABLE 1-continued

Mutated LbCas12a Residues

| | | |
|---|---|---|
| 481 | NR ES YGDF*V*LAYDILLK DHI DA RN V  KPY K KY    F   PQFMG  DKDKET<br>NRDESFYGDFVLAYDILLKVDHIYDAIRNYVTQKPYSKDKFKLYFQNPQFMGGWDKDKET | 540 |
| 541 | D  A  L      YYLAIMD KYAK LQKI   DVNG*N*Y  INYKLLPGPNKML *K*VF S<br>DYRATILRYGSKYYLAIMDKKYAKCLQKIDKDDVNGNYEKINYKLLPGPNKMLPKVFFSK | 600 |
| 601 | WMAY*Y* PS DIQK YK  TK  GDMF LNDCHK IDF DS ISR*Y*PKWSNA DFN S T<br>KWMAYYNPSEDIQKIYKNGTFKKGDMFNLNDCHKLIDFFKDSISRYPKWSNAYDFNFSET | 660 |
| 661 | EK  *D* AGFY  VE    Y  SFESASKK V KL  EGKLY FQ YNKDFS  SHGT N<br>EKYKDIAGFYREVEEQGYKVSFESASKKEVDKLVEEGKLYMFQIYNKDFSDKSHGTPNLH | 720 |
| 721 | M  KL FD N*N*HGQIRLSGGAEL*F*MR ASLK  ELVVH A S IA      DNKKTTTLS<br>TMYFKLLFDENNHGQIRLSGGAELFMRRASLKKEELVVHPANSPIANKNPDNPKKTTTLS | 780 |
| 781 | YDV K FSED  *E*  I*P*IA NKCPKNIFK  *T*EV      D  PYVIGIDR ERNL*L*Y<br>YDVVYKDKRFSEDQYELHIPIAINKCPKNIFKINTEVRVLLKHDDNPYVIGIDRGERNLLY | 840 |
| 841 | *I*VV   G  GNIVEQYSLN*E*I*I*NN  N IRI   DYH LLDKKEK RFE RQN*W*T  I    K*E*L<br>IVVVDGKGNIVEQYSLNEIINNFNGIRIKTDYHSLLDKKEKERFEARQNWTSIENIKELK | 900 |
| 901 | AGYISQVV*H*KI  *E*L  KYDAVIA EDLNS FKNSR KVEKQV  K EKM I  KLNY V<br>AGYISQVVHKICELVEKYDAVIALEDLNSGFKNSRVKVEKQVYQKFEKMLIDKLNYMVDK | 960 |
| 961 | P ATG A KGYQIT KF*E*S KSMST  GF  YIPAW    K D    GF     KTKYT*S*<br>KSNPCATGGALKGYQITNKFESFKSMSTQNGFIFYIPAWLTSKIDPSTGFVNLLKTKYTS | 1020 |
| 1021 | IADSKKF S   DRIM V   ED FEFAL YKNFSR DA Y K WKLY YGNRIR    NKK<br>IADSKKFISSFDRIMYVPEEDLFEFALDYKNFSRTDADYIKKWKLYSYGNRIRIFRNPKK | 1080 |
| 1081 | NN*V*F  W   VCLTSA KELFNKYGINY      IRA LC  SD*K*AFY  FMA MSLM QMRS<br>NNVFDWEEVCLTSAYKELFNKYGINYQQGDIRALLCEQSDKAFYSSFMALMSLMLQMRNS | 1140 |
| 1141 | ITGRTDVDFL SPVKNS G  YD RNY AQ  A  PKN DANGA N A    L AIGQFK<br>ITGRTDVDFLISPVKNSDGIFYDSRNYEAQENAILPKNADANGAYNIARKVLWAIGQFKK | 1200 |
| 1201 | AEDEK D  *V*KIA      EW EYAQTS KH<br>AEDEKLDKVKIAISNKEWLEYAQTSVKH | 1228 |

The top line shows the wild-type amino acid residues that were mutated; the bottom line has the wild-type LbCas12a sequence. The 10 bolded residues had the greatest average scores for the mutations K278D, S431T, E433P, F745T, G715R, N732L, K878A, A920P, I922R, and V1209R (see FIG. 2). The bold italicized residues indicate the position for the G146R, S396D, K478R, K595R, E795Q, T814G, E898N, V1083W, F81E, E125K, N145R, T152K, R182V, V491D, N582R, Y606F, Y646H, D665N, P799V, L839F, I841A, E858V, I860R, W890A, H909K, E913R, E981V, S1020E, or K1121D mutations.

In the wild-type LbCas12a polypeptide sequence shown above, bolded italicized amino acids indicate wild-type amino acids that are substituted as described herein either individually or in combination. The LbCas12a mutants described herein are useful as research tools or for therapeutic use for any CRISPR/Cas12a DNA cleavage or gene editing experiments or treatments. The superior activity of these mutants could potentially enhance the editing efficiency of LbCas12a, and directly replace the WT-LbCas12a in the application of genome editing.

One embodiment described herein is an isolated mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence. In one aspect, the mutant LbCas12a polypeptide has 95% to 99% identity to a polypeptide sequence selected from the even numbered sequences of SEQ ID NO: 4-4022. In another aspect, the mutant LbCas12a polypeptide has a polypeptide sequence selected from the even numbered sequences of SEQ ID NO: 4-4022. In another aspect, the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2. In another aspect, the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2. In another aspect, the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598. In another aspect, the mutant LbCas12a polypeptide comprises a substitution mutation selected from: (a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or (b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121. In another aspect, the multiple substitution mutations comprise: E88A/E795Q, E125K/E795Q, G146R/E795Q, R182V/E795Q, V491D/E795Q, Q5291/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, G146R/R182V/E795Q/P799V/T814K, or E125K/G146R/R182V/E795Q/D665N/E981V. In another aspect, the multiple substitution mutations comprise: E88A/E795Q, E125K/E795Q, G146R/E795Q, R182V/E795Q, V491D/E795Q, Q5291/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K, and provide an improvement in CRISPR/LbCas12a-associated nuclease activity at non-canonical TTTT PAM sites as compared to the wild-type LbCas12a polypeptide sequence. In another aspect, the mutant LbCas12a polypeptide is selected from SEQ ID NO: 802, 428, 2902, 156, 694, 98, 954, 134, 1730, 642, 720, 1014, 930, 706, 834, 988, 114, 250, 3958, 48, 70, 1960, 880, 532, 598, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, or 4022. In another aspect, the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q5291/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020). In another aspect, the mutant LbCas12a polypeptide is G146R/R182V/E795Q (SEQ ID NO: 3984).

Another embodiment described herein is an isolated polynucleotide sequence encoding a mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence. In one aspect, the encoded mutant LbCas12a polypeptide has 95% to 99% identity to a polypeptide sequence selected from the even numbered sequences of SEQ ID NO: 4-4022. In another aspect, the encoded mutant LbCas12a polypeptide has a polypeptide sequence selected from the even numbered sequences of SEQ ID NO: 4-4022. In another aspect, the mutant LbCas12a polynucleotide sequence has 95% to 99% identity to a nucleotide sequence selected from the odd numbered sequences of SEQ ID NO: 3-4021. In another aspect, the mutant LbCas12a polynucleotide has a nucleotide sequence selected from the odd numbered sequences of SEQ ID NO: 3-4021. In another aspect, the encoded mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2. In another aspect, the encoded mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D as compared to the wild-type LbCas12a polypeptide sequence of SEQ ID NO: 2. In another aspect, the mutant LbCas12a polynucleotide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598.

In another aspect, the encoded mutant LbCas12a polypeptide comprises a substitution mutation selected from: (a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or (b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121. In another aspect, the multiple substitution mutations comprise: E88A/E795Q, E125K/E795Q, G146R/E795Q, R182V/E795Q, V491D/E795Q, Q5291/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, G146R/R182V/E795Q/P799V/T814K, or E125K/G146R/R182V/E795Q/D665N/E981V. In another aspect, the multiple substitution mutations comprise: E88A/E795Q, E125K/E795Q, G146R/E795Q, R182V/E795Q, V491D/E795Q, Q5291/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K, and provide an improvement in CRISPR/LbCas12a-associated nuclease activity at non-canonical TTTT PAM sites as compared to the wild-type LbCas12a polypeptide sequence. In another aspect, the encoded mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q5291/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020). In another aspect, the encoded mutant LbCas12a polypeptide is G146R/R182V/E795Q (SEQ ID NO: 3984). In another aspect, the mutant LbCas12a polynucleotide is selected from SEQ ID NO: 801, 427, 2901, 155, 693, 97, 953, 133, 1729, 641, 719, 1013, 929, 705, 833, 987, 113, 249, 3957, 47, 69, 1959, 879, 531, 597, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, 4019, or 4021. In another aspect, the mutant LbCas12a polynucleotide is selected from SEQ ID NO: 801, 427, 2901, 155, 693, 97, 953, 133, 1729, 1013, 929, 705, 113, 249, 531, 597, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, or 4019, and encodes a mutant LbCas12a polypeptide that provides an improvement in CRISPR/LbCas12a-associated nuclease activity at non-canonical TTTT PAM sites as compared to the wild-type LbCas12a polypeptide sequence. In another aspect, the mutant LbCas12a polynucleotide is SEQ ID NO: 3983.

Another embodiment described herein is a vector or plasmid comprising any of the polynucleotide sequences described herein.

Another embodiment described herein is a cell comprising any of the polynucleotide sequences described herein or the vectors or plasmids described herein.

Another embodiment described herein is an isolated ribonucleoprotein complex comprising a guide RNA and a mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence. In one aspect, the mutant LbCas12a polypeptide has a polypeptide sequence selected from the even numbered sequences of SEQ ID NO: 4-4022. In another aspect, the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2. In another aspect, the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2. In another aspect, the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598. In another aspect, the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q5291/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020). In another aspect, the mutant LbCas12a polypeptide is G146R/R182V/E795Q (SEQ ID NO: 3984).

Another embodiment described herein is a method for increasing efficiency of gene editing at non-canonical TTTT PAM sites in a cell with a CRISPR ribonucleoprotein complex, the method comprising contacting a cell with the CRISPR ribonucleoprotein complex that includes a guide RNA and a mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence. In one aspect, the mutant LbCas12a polypeptide has a polypeptide sequence selected from the even numbered sequences of SEQ ID NO: 4-4022. In another aspect, the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2. In another aspect, the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2. In another aspect, the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598. In another aspect, the mutant LbCas12a polypeptide comprises a substitution mutation selected from (a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or (b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121. In another aspect, the multiple substitution mutations comprise: E88A/E795Q, E125K/E795Q, G146R/E795Q, R182V/E795Q, V491D/E795Q, Q5291/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K. In another aspect, the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q5291/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020). In another aspect, the mutant LbCas12a polypeptide is G146R/R182V/E795Q (SEQ ID NO: 3984).

Another embodiment described herein is a kit for increasing efficiency of gene editing at non-canonical TTTT PAM sites in a cell, the kit comprising a CRISPR ribonucleoprotein complex that includes a guide RNA and a mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence. In one aspect, the mutant LbCas12a polypeptide has a polypeptide sequence selected from the even numbered sequences of SEQ ID NO: 4-4022. In another aspect, the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2. In another aspect, the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2. In another aspect, the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598. In another aspect, the mutant LbCas12a polypeptide comprises a substitution mutation selected from (a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or (b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121. In another aspect, the multiple substitution mutations comprise: E88A/E795Q, E125K/E795Q, G146R/E795Q, R182V/E795Q, V491D/E795Q, Q529I/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K. In another aspect, the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q529I/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020). In another aspect, the mutant LbCas12a polypeptide is G146R/R182V/E795Q (SEQ ID NO: 3984).

Another embodiment described herein is the use of a mutant LbCas12a polypeptide for improving CRISPR/LbCas12a-associated nuclease activity at non-canonical TTTT PAM sites, wherein the mutant LbCas12a polypeptide comprises at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence. In one aspect, the mutant LbCas12a polypeptide has a polypeptide sequence selected from the even numbered sequences of SEQ ID NO: 4-4022. In another aspect, the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2. In another aspect, the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2. In another aspect, the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598. In another aspect, the mutant LbCas12a polypeptide comprises a substitution mutation selected from (a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or (b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121. In another aspect, the multiple substitution mutations comprise: E88A/E795Q, E125K/E795Q, G146R/E795Q, R182V/E795Q, V491D/E795Q, Q5291/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K. In another aspect, the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q5291/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020). In another aspect, the mutant LbCas12a polypeptide is G146R/R182V/E795Q (SEQ ID NO: 3984).

Another embodiment described herein is a method for expressing and purifying a mutant LbCas13a protein, the method comprising: (a) inserting a nucleotide sequence encoding a mutant LbCas12a polypeptide comprising at least one amino acid substitution compared to a wild-type LbCas12a polypeptide sequence and having 95-99% identity to any one of the even numbered polypeptide sequences of SEQ ID NO: 4-4022 into an expression plasmid; (b) transforming one or more cells with the expression plasmid; (c) inducing expression of the transformed plasmid; (d) isolating the cells; (e) extracting the mutant LbCas13a protein; and (f) purifying the mutant LbCas13a protein; wherein the mutant LbCas12a polypeptide provides an improvement in CRISPR/LbCas12a-associated nuclease activity at non-canonical TTTT PAM sites as compared to a wild-type LbCas12a polypeptide sequence.

Another embodiment described herein is a mutant LbCas12a polypeptide produced by a method described herein.

Another embodiment described herein is a process for manufacturing one or more of the nucleotide sequences described herein or a polypeptide encoded by the nucleotide sequences described herein, the process comprising: transforming or transfecting a cell with a nucleic acid comprising a nucleotide sequence described herein; growing the cells; optionally isolating additional quantities of a nucleotide sequence described herein; inducing expression of a polypeptide encoded by a nucleotide sequence described herein; isolating the polypeptide encoded by a nucleotide described herein.

Another embodiment described herein is a means for manufacturing one or more of the nucleotide sequences described herein or a polypeptide encoded by a nucleotide sequence described herein, the process comprising: transforming or transfecting a cell with a nucleic acid comprising a nucleotide sequence described herein; growing the cells; optionally isolating additional quantities of a nucleotide sequence described herein; inducing expression of a polypeptide encoded by a nucleotide sequence described herein; isolating the polypeptide encoded by a nucleotide described herein.

Another embodiment described herein is a nucleotide sequence or a polypeptide encoded by the nucleotide sequence produced by the method or the means described herein.

Another embodiment described herein is the use of an effective amount of a polypeptide encoded by one or more of the nucleotide sequences described herein in a CRISPR/Cas12a system.

Another embodiment described herein is a research tool comprising a polypeptide encoded by a nucleotide sequence described herein.

Another embodiment described herein is a biochemical reagent or therapeutic comprising a polypeptide encoded by a nucleotide sequence described herein.

The polynucleotides described herein include variants that have substitutions, deletions, and/or additions that can involve one or more nucleotides. The variants can be altered in coding regions, non-coding regions, or both. Alterations in the coding regions can produce conservative or non-conservative amino acid substitutions, deletions, or additions. Especially preferred among these are silent substitutions, additions, and deletions that do not alter the activity.

Further embodiments described herein include nucleic acid molecules comprising polynucleotides having nucleotide sequences about 50%, 55%, 60%, 65%, 70%, 75%, 80%, 85%, 90%, 91%, 92%, 93%, 94%, 95%, 96%, 97%, 98%, or 99% identical, and more preferably at least about 90-99% identical to (a) nucleotide sequences, or degenerate, homologous, or codon-optimized variants thereof, encoding polypeptides having the amino acid sequences in the even numbered sequences of SEQ ID NO: 4-4022; (b) nucleotide sequences, or degenerate, homologous, or codon-optimized variants thereof, encoding polypeptides having the amino acid sequences in the even numbered sequences of SEQ ID NO: 4-4022; and (c) nucleotide sequences capable of hybridizing to the complement of any of the nucleotide sequences in (a) or (b) above and capable of expressing functional polypeptides of amino acid sequences in the even numbered sequences of SEQ ID NO: 4-4022.

By a polynucleotide having a nucleotide sequence at least, for example, 90-99% "identical" to a reference nucleotide sequence encoding a mutant LbCas12a is intended that the nucleotide sequence of the polynucleotide be identical to the reference sequence except that the polynucleotide sequence can include up to about 10 to 1 point mutations, additions, or deletions per each 100 nucleotides of the reference nucleotide sequence encoding the mutant LbCas12a.

In other words, to obtain a polynucleotide having a nucleotide sequence about at least 90-99% identical to a reference nucleotide sequence, up to 10% of the nucleotides in the reference sequence can be deleted, added, or substituted, with another nucleotide, or a number of nucleotides up to 10% of the total nucleotides in the reference sequence can be inserted into the reference sequence. These mutations of the reference sequence can occur at the 5′- or 3′-terminal positions of the reference nucleotide sequence or anywhere between those terminal positions, interspersed either individually among nucleotides in the reference sequence or in one or more contiguous groups within the reference sequence. The same is applicable to polypeptide sequences about at least 90-99% identical to a reference polypeptide sequence.

As noted above, two or more polynucleotide sequences can be compared by determining their percent identity. Two or more amino acid sequences likewise can be compared by determining their percent identity. The percent identity of two sequences, whether nucleic acid or peptide sequences, is generally described as the number of exact matches between two aligned sequences divided by the length of the shorter sequence and multiplied by 100. An approximate alignment for nucleic acid sequences is provided by the local homology algorithm of Smith and Waterman, *Advances in Applied Mathematics* 2: 4 82-489 (1981).

Due to the degeneracy of the genetic code, a large number of the nucleic acid molecules having a sequence at least 50%, 55%, 60%, 65%, 70%, 75%, 80%, 85%, 90%, 91%, 92%, 93%, 94%, 95%, 96%, 97%, 98%, or 99% identical to the nucleic acid sequences shown in odd numbered sequences of SEQ ID NO: 3-4021, or degenerate, homologous, or codon-optimized variants thereof, will encode a mutant LbCas12a.

The polynucleotides described herein include those encoding mutations, variations, substitutions, additions, deletions, and particular examples of the polypeptides described herein. For example, guidance concerning how to make phenotypically silent amino acid substitutions is provided in Bowie, J. U. et al., "Deciphering the Message in Protein Sequences: Tolerance to Amino Acid Substitutions," *Science* 247: 1306-1310 (1990), wherein the authors indicate that proteins are surprisingly tolerant of amino acid substitutions.

Thus, fragments, derivatives, or analogs of the polypeptides of the even numbered sequences of SEQ ID NO: 4-4022 can be (i) ones in which one or more of the amino acid residues (e.g., 1, 2, 3, 4, 5, 7, 8, 9, 10, 11, 12, 13, 14, 15, 16, 17, 18, 19, 20, 25, 30, 35, 40, 45, or 50 residues, or even more) are substituted with a conserved or non-conserved amino acid residue (preferably a conserved amino acid residue). Such substituted amino acid residues may or may not be one encoded by the genetic code, or (ii) ones in which one or more of the amino acid residues includes a substituent group (e.g., 1, 2, 3, 4, 5, 7, 8, 9, 10, 15, 20, 25, 30, 35, 40, 45, or 50 residues or even more), or (iii) ones in which the mature polypeptide is fused with another polypeptide or compound, such as a compound to increase the half-life of the polypeptide (for example, polyethylene glycol), or (iv) ones in which the additional amino acids are fused to the mature polypeptide, such as an IgG Fc fusion region peptide or leader or secretory sequence or a sequence which is employed for purification of the mature polypeptide or a proprotein sequence. Such fragments, derivatives, and analogs are deemed to be within the scope of those skilled in the art from the teachings herein.

In addition, fragments, derivatives, or analogs of the polypeptides of the even numbered sequences of SEQ ID NO: 4-4022 can be substituted with one or more conserved or non-conserved amino acid residue (preferably a conserved amino acid residue). In some cases these polypeptides, fragments, derivatives, or analogs thereof will have a polypeptide sequence at least 50%, 55%, 60%, 65%, 70%, 75%, 80%, 85%, 90%, 91%, 92%, 93%, 94%, 95%, 96%, 97%, 98%, or 99% identical to the polypeptide sequence shown in the even numbered sequences of SEQ ID NO: 4-4022 and will comprise functional or non-functional proteins or enzymes. Similarly, additions or deletions to the polypeptides can be made either at the N- or C-termini or within non-conserved regions of the polypeptide (which are assumed to be non-critical because they have not been photogenically conserved).

As described herein, in many cases the amino acid substitutions, mutations, additions, or deletions are preferably of a minor nature, such as conservative amino acid substitutions that do not significantly affect the folding or activity of the protein or additions or deletions to the N- or C-termini. Of course, the number of amino acid substitutions, additions, or deletions a skilled artisan would make depends on many factors, including those described herein. Generally, the number of substitutions, additions, or deletions for any given polypeptide will not be more than about 100, 90, 80, 70, 60, 50, 40, 30, 25, 20, 19, 18, 17, 16, 15, 14, 13, 12, 11, 10, 9, 8, 7, 5, 6, 4, 3, 2, or 1.

The applications of Cas12a and LbCas12a based tools are many and varied. The applications include, but are not limited to: plant gene editing, yeast gene editing, mammalian gene editing, editing of cells in the organs of live animals, editing of embryos, rapid generation of knockout/knock-in animal lines, generating an animal model of disease state, correcting a disease state, inserting a reporter gene, and whole genome functional screening.

It will be apparent to one of ordinary skill in the relevant art that suitable modifications and adaptations to the compositions, formulations, methods, processes, and applications described herein can be made without departing from the scope of any embodiments or aspects thereof. The compositions and methods provided are exemplary and are not intended to limit the scope of any of the specified embodiments. All of the various embodiments, aspects, and options disclosed herein can be combined in any variations or iterations. The scope of the compositions, formulations, methods, and processes described herein include all actual or potential combinations of embodiments, aspects, options, examples, and preferences herein described. The exemplary compositions and formulations described herein may omit any component, substitute any component disclosed herein, or include any component disclosed elsewhere herein. The ratios of the mass of any component of any of the compositions or formulations disclosed herein to the mass of any other component in the formulation or to the total mass of the other components in the formulation are hereby disclosed as if they were expressly disclosed. Should the meaning of any terms in any of the patents or publications incorporated by reference conflict with the meaning of the terms used in this disclosure, the meanings of the terms or phrases in this disclosure are controlling. Furthermore, the foregoing discussion discloses and describes merely exemplary embodiments. All patents and publications cited herein are incorporated by reference herein for the specific teachings thereof.

Various embodiments and aspects of the inventions described herein are summarized by the following clauses:

Clause 1. An isolated mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence.

Clause 2. The isolated mutant LbCas12a polypeptide of clause 1, wherein the mutant LbCas12a polypeptide has 95% to 99% identity to a polypeptide sequence selected from the even numbered sequences of SEQ ID NO: 4-4022.

Clause 3. The isolated mutant LbCas12a polypeptide of clause 1 or 2, wherein the mutant LbCas12a polypeptide has a polypeptide sequence selected from the even numbered sequences of SEQ ID NO: 4-4022.

Clause 4. The isolated mutant LbCas12a polypeptide of any one of clauses 1-3, wherein the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2.

Clause 5. The isolated mutant LbCas12a polypeptide of any one of clauses 1-4, wherein the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2.

Clause 6. The isolated mutant LbCas12a polypeptide of any one of clauses 1-5, wherein the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598.

Clause 7. The isolated mutant LbCas12a polypeptide of any one of clauses 1-6, wherein the mutant LbCas12a polypeptide comprises a substitution mutation selected from:
(a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or
(b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121.

Clause 8. The isolated mutant LbCas12a polypeptide of any one of clauses 1-7, wherein the multiple substitution mutations comprise: E88A/E795Q, E125K/E795Q, G146R/E795Q, R182V/E795Q, V491D/E795Q, Q529I/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/

E795Q/D665N, G146R/R182V/E795Q/P799V/T814K, or E125K/G146R/R182V/E795Q/D665N/E981V.

Clause 9. The isolated mutant LbCas12a polypeptide of any one of clauses 1-8, wherein the multiple substitution mutations comprise: E88A/E795Q, E125K/E795Q, G146R/E795Q, R182V/E795Q, V491D/E795Q, Q529I/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K, and provide an improvement in CRISPR/LbCas12a-associated nuclease activity at non-canonical TTTT PAM sites as compared to the wild-type LbCas12a polypeptide sequence.

Clause 10. The isolated mutant LbCas12a polypeptide of any one of clauses 1-9, wherein the mutant LbCas12a polypeptide is selected from SEQ ID NO: 802, 428, 2902, 156, 694, 98, 954, 134, 1730, 642, 720, 1014, 930, 706, 834, 988, 114, 250, 3958, 48, 70, 1960, 880, 532, 598, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, or 4022.

Clause 11. The isolated mutant LbCas12a polypeptide of any one of clauses 1-10, wherein the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q529I/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020).

Clause 12. The isolated mutant LbCas12a polypeptide of any one of clauses 1-11, wherein the mutant LbCas12a polypeptide is G146R/R182V/E795Q (SEQ ID NO: 3984).

Clause 13. An isolated polynucleotide sequence encoding a mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence.

Clause 14. The isolated polynucleotide sequence of clause 13, wherein the encoded mutant LbCas12a polypeptide has 95% to 99% identity to a polypeptide sequence selected from the even numbered sequences of SEQ ID NO: 4-4022.

Clause 15. The isolated polynucleotide sequence of clause 13 or 14, wherein the encoded mutant LbCas12a polypeptide has a polypeptide sequence selected from the even numbered sequences of SEQ ID NO: 4-4022.

Clause 16. The isolated polynucleotide sequence of any one of clauses 13-15, wherein the mutant LbCas12a polynucleotide sequence has 95% to 99% identity to a nucleotide sequence selected from the odd numbered sequences of SEQ ID NO: 3-4021.

Clause 17. The isolated polynucleotide sequence of any one of clauses 13-16, wherein the mutant LbCas12a polynucleotide has a nucleotide sequence selected from the odd numbered sequences of SEQ ID NO: 3-4021.

Clause 18. The isolated polynucleotide sequence of any one of clauses 13-17, wherein the encoded mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2.

Clause 19. The isolated polynucleotide sequence of any one of clauses 13-18, wherein the encoded mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D as compared to the wild-type LbCas12a polypeptide sequence of SEQ ID NO: 2.

Clause 20. The isolated mutant LbCas12a polynucleotide of any one of clauses 13-19, wherein the mutant LbCas12a polynucleotide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598.

Clause 21. The isolated mutant LbCas12a polynucleotide of any one of clauses 13-20, wherein the encoded mutant LbCas12a polypeptide comprises a substitution mutation selected from:
(a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or
(b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121.

Clause 22. The isolated mutant LbCas12a polynucleotide of any one of clauses 13-21, wherein the multiple substitution mutations comprise: E88A/E795Q, E125K/E795Q, G146R/E795Q, R182V/E795Q, V491D/E795Q, Q529I/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, G146R/R182V/E795Q/P799V/T814K, or E125K/G146R/R182V/E795Q/D665N/E981V.

Clause 23. The isolated mutant LbCas12a polynucleotide of any one of clauses 13-22, wherein the multiple substitution mutations comprise: E88A/E795Q, E125K/E795Q, G146R/E795Q, R182V/E795Q, V491D/E795Q, Q529I/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K, and provide an improvement in CRISPR/LbCas12a-associated nuclease activity at non-canonical TTTT PAM sites as compared to the wild-type LbCas12a polypeptide sequence.

Clause 24. The isolated mutant LbCas12a polynucleotide of any one of clauses 13-23, wherein the encoded mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q529I/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020).

Clause 25. The isolated mutant LbCas12a polynucleotide of any one of clauses 13-24, wherein the encoded mutant LbCas12a polypeptide is G146R/R182V/E795Q (SEQ ID NO: 3984).

Clause 26. The isolated mutant LbCas12a polynucleotide of any one of clauses 13-25, wherein the mutant LbCas12a polynucleotide is selected from SEQ ID NO: 801, 427, 2901, 155, 693, 97, 953, 133, 1729, 641, 719, 1013, 929, 705, 833, 987, 113, 249, 3957, 47, 69, 1959, 879, 531, 597, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, 4019, or 4021.

Clause 27. The isolated mutant LbCas12a polynucleotide of any one of clauses 13-26, wherein the mutant LbCas12a polynucleotide is selected from SEQ ID NO: 801, 427, 2901, 155, 693, 97, 953, 133, 1729, 1013, 929, 705, 113, 249, 531, 597, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, or 4019, and encodes a mutant LbCas12a polypeptide that provides an improvement in CRISPR/LbCas12a-associated nuclease activity at non-canonical TTTT PAM sites as compared to the wild-type LbCas12a polypeptide sequence.

Clause 28. The isolated mutant LbCas12a polynucleotide of any one of clauses 13-27, wherein the mutant LbCas12a polynucleotide is SEQ ID NO: 3983.

Clause 29. A vector or plasmid comprising the polynucleotide sequence of any one of clauses 13-28.

Clause 30. A cell comprising the polynucleotide sequence of any one of clauses 13-28 or the vector or plasmid of clause 29.

Clause 31. An isolated ribonucleoprotein complex comprising a guide RNA and a mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence.

Clause 32. The isolated ribonucleoprotein complex of clause 31, wherein the mutant LbCas12a polypeptide has a polypeptide sequence selected from the even numbered sequences of SEQ ID NO: 4-4022.

Clause 33. The isolated ribonucleoprotein complex of clause 31 or 32, wherein the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2.

Clause 34. The isolated ribonucleoprotein complex of any one of clauses 31-33, wherein the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2.

Clause 35. The isolated ribonucleoprotein complex of any one of clauses 31-34, wherein the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598.

Clause 36. The isolated ribonucleoprotein complex of any one of clauses 31-35, wherein the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q5291/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020).

Clause 37. The isolated ribonucleoprotein complex of any one of clauses 31-36, wherein the mutant LbCas12a polypeptide is G146R/R182V/E795Q (SEQ ID NO: 3984).

Clause 38. A method for increasing efficiency of gene editing at non-canonical TTTT PAM sites in a cell with a CRISPR ribonucleoprotein complex, the method comprising: contacting a cell with the CRISPR ribonucleoprotein complex that includes a guide RNA and a mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence.

Clause 39. The method of clause 38, wherein the mutant LbCas12a polypeptide has a polypeptide sequence selected from the even numbered sequences of SEQ ID NO: 4-4022.

Clause 40. The method of clause 38 or 39, wherein the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2.

Clause 41. The method of any one of clauses 38-40, wherein the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2.

Clause 42. The method of any one of clauses 38-41, wherein the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO:

706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598.

Clause 43. The method of any one of clauses 38-42, wherein the mutant LbCas12a polypeptide comprises a substitution mutation selected from:
(a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or
(b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121.

Clause 44. The method of any one of clauses 38-43, wherein the multiple substitution mutations comprise: E88A/E795Q, E125K/E795Q, G146R/E795Q, R182V/E795Q, V491D/E795Q, Q529I/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K.

Clause 45. The method of any one of clauses 38-44, wherein the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q529I/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020).

Clause 46. The method of any one of clauses 38-45, wherein the mutant LbCas12a polypeptide is G146R/R182V/E795Q (SEQ ID NO: 3984).

Clause 47. A kit for increasing efficiency of gene editing at non-canonical TTTT PAM sites in a cell, the kit comprising:
a CRISPR ribonucleoprotein complex that includes a guide RNA and a mutant LbCas12a polypeptide comprising at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence.

Clause 48. The kit of clause 47, wherein the mutant LbCas12a polypeptide has a polypeptide sequence selected from the even numbered sequences of SEQ ID NO: 4-4022.

Clause 49. The kit of clause 47 or 48, wherein the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2.

Clause 50. The kit of any one of clauses 47-49, wherein the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2.

Clause 51. The kit of any one of clauses 47-50, wherein the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598.

Clause 52. The kit of any one of clauses 47-51, wherein the mutant LbCas12a polypeptide comprises a substitution mutation selected from:
(a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or
(b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121.

Clause 53. The kit of any one of clauses 47-52, wherein the multiple substitution mutations comprise: E88A/E795Q, E125K/E795Q, G146R/E795Q, R182V/E795Q, V491D/E795Q, Q529I/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K.

Clause 54. The kit of any one of clauses 47-53, wherein the mutant LbCas12a polypeptide is selected from:
F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q529I/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020).

Clause 55. The kit of any one of clauses 47-54, wherein the mutant LbCas12a polypeptide is G146R/R182V/E795Q (SEQ ID NO: 3984).

Clause 56. Use of a mutant LbCas12a polypeptide for improving CRISPR/LbCas12a-associated nuclease activity at non-canonical TTTT PAM sites, wherein the mutant LbCas12a polypeptide comprises at least one amino acid substitution introduced into a wild-type LbCas12a polypeptide sequence of SEQ ID NO: 2, provided that the mutant LbCas12a polypeptide provides an improvement in CRISPR/LbCas12a-associated nuclease activity at non-canonical TTTT PAM sites as compared to the wild-type LbCas12a polypeptide sequence.

Clause 57. The use of clause 56, wherein the mutant LbCas12a polypeptide has a polypeptide sequence selected from the even numbered sequences of SEQ ID NO: 4-4022.

Clause 58. The use of clause 56 or 57, wherein the mutant LbCas12a polypeptide comprises at least one amino acid substitution at positions 81, 125, 145, 146, 152, 182, 396, 478, 491, 582, 595, 606, 646, 665, 795, 799, 814, 839, 841, 858, 860, 890, 898, 909, 913, 981, 1020, 1083, or 1121 of the wild-type LbCas12a polypeptide sequence of SEQ ID NO: 2.

Clause 59. The use of any one of clauses 56-58, wherein the mutant LbCas12a polypeptide comprises at least one amino acid substitution selected from F81E, E125K, N145R, G146R, T152K, R182V, S396D, K478R, V491D, N582R, K595R, Y606F, Y646H, D665N, E795Q, P799V, T814G, L839F, I841A, E858V, I860R, W890A, E898N, H909K, E913R, E981V, S1020E, V1083W, or K1121D of the wild-type LbCas12a polypeptide sequence of SEQ ID NO: 2.

Clause 60. The use of any one of clauses 56-59, wherein the mutant LbCas12a polypeptide is selected from: F81E, SEQ ID NO: 802; E125K, SEQ ID NO: 428; N145R, SEQ ID NO: 2902; G146R, SEQ ID NO: 156; T152K, SEQ ID NO: 694; R182V, SEQ ID NO: 98; S396D, SEQ ID NO: 108; K478R, SEQ ID NO: 134; V491D, SEQ ID NO: 954; N582R, SEQ ID NO: 1730; K595R, SEQ ID NO: 184; Y606F, SEQ ID NO: 642; Y646H, SEQ ID NO: 720; D665N, SEQ ID NO: 1014; E795Q, SEQ ID NO: 930; P799V, SEQ ID NO: 706; T814G, SEQ ID NO: 162; L839F, SEQ ID NO: 834; I841A, SEQ ID NO: 988; E858V, SEQ ID NO: 114; I860R, SEQ ID NO: 250; W890A, SEQ ID NO: 3958; E898N, SEQ ID NO: 48; H909K, SEQ ID NO: 70; E913R, SEQ ID NO: 1960; E981V, SEQ ID NO: 880; S1020E, SEQ ID NO: 532; V1083W, SEQ ID NO: 132; or K1121D, SEQ ID NO: 598.

Clause 61. The use of any one of clauses 56-60, wherein the mutant LbCas12a polypeptide comprises a substitution mutation selected from:
(a) a single substitution mutation introduced into the wild-type LbCas12a polypeptide sequence of SEQ ID NO: 2 selected from the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121; or
(b) a multiple substitution mutation introduced into the wild-type LbCas12a polypeptide sequence of SEQ ID NO: 2 selected from at least two of the following positions: F81, E125, N145, G146, T152, R182, S396, K478, V491, N582, K595, Y606, Y646, D665, E795, P799, T814, L839, I841, E858, I860, W890, E898, H909, E913, E981, S1020, V1083, or K1121.

Clause 62. The use of any one of clauses 56-61, wherein the multiple substitution mutations comprise: E88A/E795Q, E125K/E795Q, G146R/E795Q, R182V/E795Q, V491D/E795Q, Q529I/E795Q, Y646H/E795Q, D665N/E795Q, T814K/E795Q, L839F/E795Q, Q906F/E795Q, E795Q/Q1170D, G146R/R182V/E795Q, G146R/E795Q/D665N, G146R/E795Q/E981V, G146R/E795Q/T814K, G146R/R182V/D665N, E125K/R182V/E981V, R182V/P799V/E981V, R182V/T814K/E981V, G146R/P799V/E981V, G146R/R182V/E795Q/F81E, G146R/R182V/E795Q/E125K, G146R/R182V/E795Q/E125A, G146R/R182V/E795Q/P799V, G146R/R182V/E795Q/T814K, G146R/R182V/E795Q/E981V, G146R/R182V/E795Q/D665N, G146R/R182V/P799V/E981V, E125K/G146R/R182V/E795Q/D665N, or G146R/R182V/E795Q/P799V/T814K.

Clause 63. The use of any one of clauses 56-62, wherein the mutant LbCas12a polypeptide is selected from: F81E (SEQ ID NO: 802), E125K (SEQ ID NO: 428), N145R (SEQ ID NO: 2902), G146R (SEQ ID NO: 156), T152K (SEQ ID NO: 694), R182V (SEQ ID NO: 98), V491D (SEQ ID NO: 954), K478R (SEQ ID NO: 134), N582R (SEQ ID NO: 1730), D665N (SEQ ID NO: 1014), E795Q (SEQ ID NO: 930), P799V (SEQ ID NO: 706), E858V (SEQ ID NO: 114), I860R (SEQ ID NO: 250), E913R (SEQ ID NO: 1960), E981V (SEQ ID NO: 880), E88A/E795Q (SEQ ID NO: 3960), E125K/E795Q (SEQ ID NO: 3962), G146R/E795Q (SEQ ID NO: 3964), R182V/E795Q (SEQ ID NO: 3966), V491D/E795Q (SEQ ID NO: 3968), Q529I/E795Q (SEQ ID NO: 3970), Y646H/E795Q (SEQ ID NO: 3972), D665N/E795Q (SEQ ID NO: 3974), T814K/E795Q (SEQ ID NO: 3976), L839F/E795Q (SEQ ID NO: 3978), Q906F/E795Q (SEQ ID NO: 3980), E795Q/Q1170D (SEQ ID NO: 3982), G146R/R182V/E795Q (SEQ ID NO: 3984), G146R/E795Q/D665N (SEQ ID NO: 3986), G146R/E795Q/E981V (SEQ ID NO: 3988), G146R/E795Q/T814K (SEQ ID NO: 3990), G146R/R182V/D665N (SEQ ID NO: 3992), E125K/R182V/E981V (SEQ ID NO: 3994), R182V/P799V/E981V (SEQ ID NO: 3996), R182V/T814K/E981V (SEQ ID NO: 3998), G146R/P799V/E981V (SEQ ID NO: 4000), G146R/R182V/E795Q/F81E (SEQ ID NO: 4002), G146R/R182V/E795Q/E125K (SEQ ID NO: 4004), G146R/R182V/E795Q/E125A (SEQ ID NO: 4006), G146R/R182V/E795Q/P799V (SEQ ID NO: 4008), G146R/R182V/E795Q/T814K (SEQ ID NO: 4010), G146R/R182V/E795Q/E981V (SEQ ID NO: 4012), G146R/R182V/E795Q/D665N (SEQ ID NO: 4014), G146R/R182V/P799V/E981V (SEQ ID NO: 4016), E125K/G146R/R182V/E795Q/D665N (SEQ ID NO: 4018), or G146R/R182V/E795Q/P799V/T814K (SEQ ID NO: 4020).

Clause 64. The use of any one of clauses 56-63, wherein the mutant LbCas12a polypeptide is G146R/R182V/E795Q (SEQ ID NO: 3984).

Clause 65. A method for expressing and purifying a mutant LbCas13a protein, the method comprising:
(a) inserting a nucleotide sequence encoding a mutant LbCas12a polypeptide comprising at least one amino acid substitution compared to a wild-type LbCas12a polypeptide sequence and having 95-99% identity to any one of the even numbered polypeptide sequences of SEQ ID NO: 4-4022 into an expression plasmid;
(b) transforming one or more cells with the expression plasmid;
(c) inducing expression of the transformed plasmid;
(d) isolating the cells;
(e) extracting the mutant LbCas13a protein; and
(f) purifying the mutant LbCas13a protein;
wherein the mutant LbCas12a polypeptide provides an improvement in CRISPR/LbCas12a-associated nuclease activity at non-canonical TTTT PAM sites as compared to a wild-type LbCas12a polypeptide sequence.

Clause 66. The mutant LbCas12a polypeptide produced by the method of clause 65.

REFERENCES

Zetsche et al. "Cpf1 Is a Single RNA-Guided Endonuclease of a Class 2 CRISPR-Cas System," *Cell* 163: 759-771 (2015).

Jinek et al., "A programmable dual-RNA-guided DNA endonuclease in adaptive bacterial immunity," *Science* 337: 816-821 (2012).

Schindele and Puchta, "Engineering CRISPR/LbCas12a for highly efficient, temperature-tolerant plant gene editing," *Plant Biotechnol. J.* 18(5):1118-1120 (2020).

Wrenbeck et al., "Plasmid-based one-pot saturation mutagenesis," *Nat. Methods* 13: 928-930 (2016).

EXAMPLES

Example 1

High-Throughput Measurement of the DNA Cleavage Activity of LbCas12a Variants at TTTT PAM Site in *E. coli*.

A bacterial-based directed evolution of LbCas12a was performed to identify mutations with enhanced cleavage activity. A deep-scanning mutagenesis library was created containing all possible point mutations on the amino acid level over the entire coding sequence of LbCas12a, with most clones contain only one mutation. Wrenbeck et al. *Nat. Methods* 13: 928-930 (2016), which is incorporated by reference herein. This type of library permitted direct evaluation of the phenotype of each point mutation, by measuring their relative survival rates over the LbCas12a wild-type (WT) protein in the bacterial screen.

The screening strain harboring the toxin plasmid was transformed with LbCas12a library and crRNA targeting the HPRT38346 site on the toxin plasmid. After recovery and IPTG induction, cells were plated on LB-chloramphenicol media with arabinose and incubated at 37° C. overnight. LbCas12a expression plasmids carried by the survived *E. coli* cells were extracted and purified. Both input and selected plasmid libraries were PCR amplified, randomly fragmented by Nextera library prep kit, and sequenced on Illumina NextSeq™ with ~40 million reads per library. The frequencies of mutations at each position of LbCas12a in both libraries were measured and normalized to the total coverage of each codon. The relative survival rate of each point mutation was calculated as the ratio of normalized frequency between selected and input library. The phenotype score (or activity score) is calculated as the natural logarithm of the ratio of normalized frequency between selected (Round 4) and Input Library (Round 3), where the normalized frequency of each mutant at each position is calculated as the ratio of specific mutant and synonyms change at each position. Since the degree of cell survival under the arabinose selection is indicative of the cleavage activity of LbCas12a variant at HPRT38346 protospacer, any variants that enriched during the selection over WT would be those with enhanced activity at TTTT PAM.

Figure 1B:
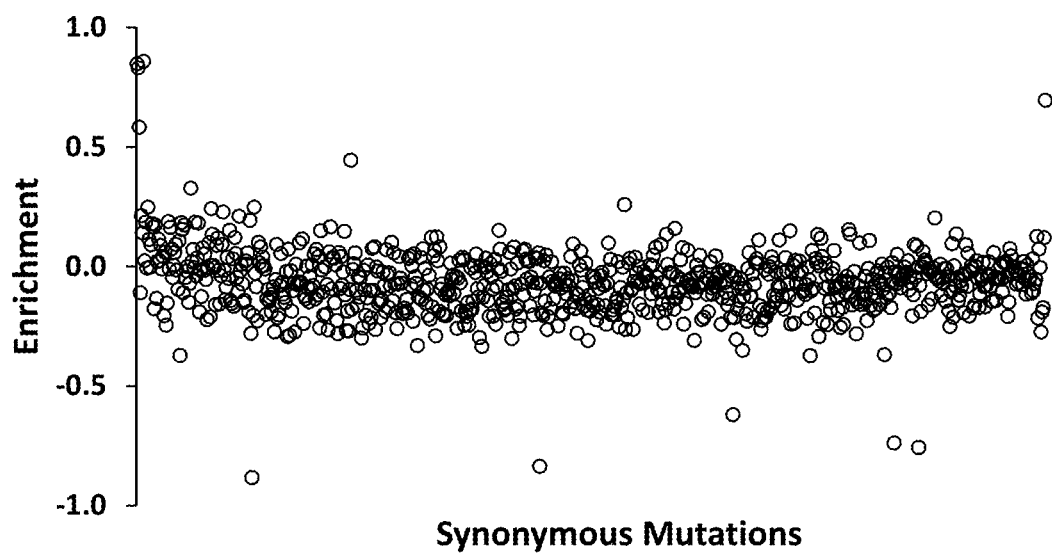
FIG. 1B shows the distribution and enrichment of synonymous mutations.
Figure 1C:
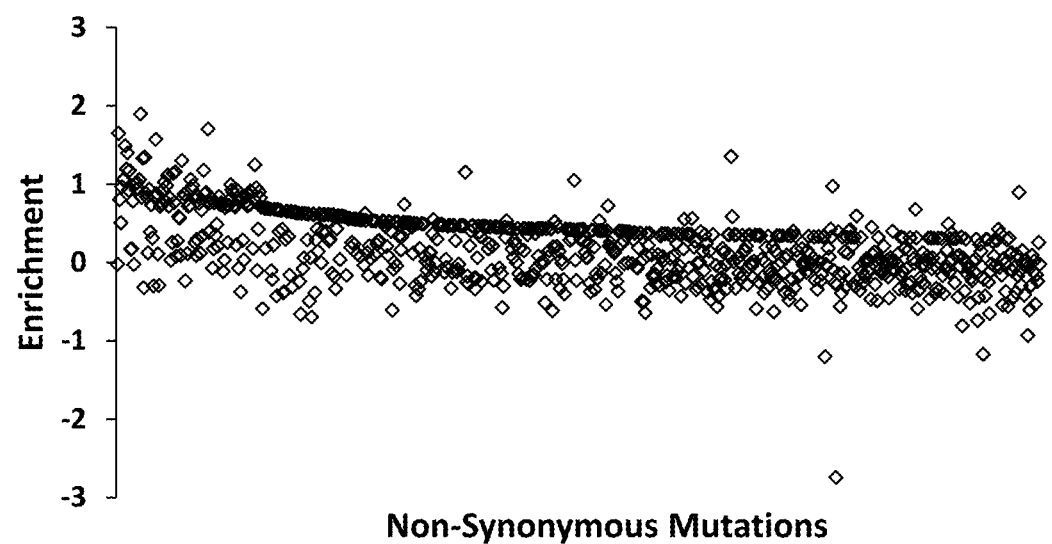
FIG. 1C shows the distribution and enrichment of non-synonymous mutations.

The phenotype scores (or activity score) of 17,278 LbCas12a variants with single point mutation are listed in Table 2. Scores for synonymous changes (n=849, 69% of all positions) tightly clustered around 0, and thus serving as the baseline activity of wild-type LbCas12a (FIG. 1A-C). Overall, 1,977 of 17,278 (~11.4%) point mutations exhibited some benefits with score greater than the 99th percentile (0.248) of all synonymous changes (FIG. 2; Table 2).

Table 2 shows point mutations enriched over the WT protein. The phenotype score is the natural logarithm of relative enrichment of point mutations over two biological replicates with beneficial phenotypes. The primers used for generating saturation mutagenesis library are shown in Table 3.

TABLE 2

Lachnospiraceae bacterium ND2006 Cas12a Wild-type and Mutants

| Mutation | Position | WT residue | Mutant residue | Average score | Standard deviation | NT SEQ ID | AA SEQ ID |
| --- | --- | --- | --- | --- | --- | --- | --- |
| WT | | Wild-type LbCas12a | | | | 1 | 2 |
| K278D | 278 | K | D | 3.8 | 0.32 | 3 | 4 |
| E433P | 433 | E | P | 3.37 | 2.93 | 5 | 6 |
| V1209R | 1209 | V | R | 3.05 | 2.28 | 7 | 8 |
| K878A | 878 | K | A | 3.02 | 2.73 | 9 | 10 |
| A920P | 920 | A | P | 2.92 | 0.37 | 11 | 12 |
| G715R | 715 | G | R | 2.92 | 3.25 | 13 | 14 |
| N732L | 732 | N | L | 2.75 | 2.81 | 15 | 16 |
| I922R | 922 | I | R | 2.75 | 0.12 | 17 | 18 |
| S431T | 431 | S | T | 2.69 | 2.93 | 19 | 20 |
| F745T | 745 | F | T | 2.46 | 3.01 | 21 | 22 |
| N1081E | 1081 | N | E | 2.44 | 2.97 | 23 | 24 |
| V851F | 851 | V | F | 2.37 | 0.05 | 25 | 26 |
| F1052P | 1052 | F | P | 2.31 | 2.27 | 27 | 28 |
| S431G | 431 | S | G | 2.31 | 2.5 | 29 | 30 |
| D832R | 832 | D | R | 2.27 | 3.46 | 31 | 32 |
| N718Q | 718 | N | Q | 2.27 | 2.61 | 33 | 34 |
| A1222R | 1222 | A | R | 2.26 | 3.34 | 35 | 36 |
| V280R | 280 | V | R | 2.25 | 2.23 | 37 | 38 |
| K804I | 804 | K | I | 2.16 | 0.77 | 39 | 40 |
| R833V | 833 | R | V | 2.09 | 3.19 | 41 | 42 |
| M531S | 531 | M | S | 2.08 | 0.01 | 43 | 44 |
| A966P | 966 | A | P | 2.03 | 0.54 | 45 | 46 |
| E898N | 898 | E | N | 2.03 | 0.02 | 47 | 48 |
| L838D | 838 | L | D | 1.96 | 2.02 | 49 | 50 |
| S185Y | 185 | S | Y | 1.95 | 0.13 | 51 | 52 |
| G477T | 477 | G | T | 1.95 | 0.06 | 53 | 54 |
| D1023S | 1023 | D | S | 1.95 | 0.63 | 55 | 56 |
| H909M | 909 | H | M | 1.94 | 0.52 | 57 | 58 |
| A1169T | 1169 | A | T | 1.92 | 1.36 | 59 | 60 |
| N803F | 803 | N | F | 1.91 | 0.5 | 61 | 62 |
| Q906F | 906 | Q | F | 1.9 | 0.04 | 63 | 64 |
| E217Q | 217 | E | Q | 1.88 | 0.61 | 65 | 66 |
| L128E | 128 | L | E | 1.86 | 3.33 | 67 | 68 |
| H909K | 909 | H | K | 1.86 | 0.18 | 69 | 70 |
| G1009Q | 1009 | G | Q | 1.86 | 1.76 | 71 | 72 |
| L287A | 287 | L | A | 1.86 | 0.63 | 73 | 74 |
| I259S | 259 | I | S | 1.86 | 0.34 | 75 | 76 |
| E939A | 939 | E | A | 1.84 | 1.26 | 77 | 78 |
| K595P | 595 | K | P | 1.84 | 2.71 | 79 | 80 |
| K427Y | 427 | K | Y | 1.83 | 1.75 | 81 | 82 |
| G734L | 734 | G | L | 1.83 | 3.68 | 83 | 84 |
| G430L | 430 | G | L | 1.83 | 3.68 | 85 | 86 |
| K804F | 804 | K | F | 1.8 | 0.83 | 87 | 88 |
| K1227C | 1227 | K | C | 1.76 | 0.7 | 89 | 90 |
| K634T | 634 | K | T | 1.75 | 1.72 | 91 | 92 |
| H633P | 633 | H | P | 1.75 | 1.72 | 93 | 94 |
| Y57E | 57 | Y | E | 1.74 | 0.76 | 95 | 96 |
| R182V | 182 | R | V | 1.7 | 0.11 | 97 | 98 |
| A923R | 923 | A | R | 1.69 | 0.06 | 99 | 100 |
| R836A | 836 | R | A | 1.67 | 2.12 | 101 | 102 |
| N1082E | 1082 | N | E | 1.67 | 2.02 | 103 | 104 |
| A1194D | 1194 | A | D | 1.67 | 0.05 | 105 | 106 |
| S396D | 396 | S | D | 1.67 | 0.19 | 107 | 108 |
| K617S | 617 | K | S | 1.66 | 0.06 | 109 | 110 |
| Q613V | 613 | Q | V | 1.66 | 0.18 | 111 | 112 |
| E858V | 858 | E | V | 1.65 | 0 | 113 | 114 |
| N256R | 256 | N | R | 1.65 | 0.18 | 115 | 116 |
| K42E | 42 | K | E | 1.64 | 2.34 | 117 | 118 |
| I503E | 503 | I | E | 1.64 | 0.07 | 119 | 120 |
| G741L | 741 | G | L | 1.62 | 0.24 | 121 | 122 |
| I102E | 1021 | I | E | 1.6 | 1.19 | 123 | 124 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| G1103T | 1103 | G | T | 1.59 | 0.18 | 125 | 126 |
| T778P | 778 | T | P | 1.58 | 1.44 | 127 | 128 |
| R1138D | 1138 | R | D | 1.58 | 1.71 | 129 | 130 |
| V1083W | 1083 | V | W | 1.57 | 0.18 | 131 | 132 |
| K478R | 478 | K | R | 1.57 | 0.05 | 133 | 134 |
| P806D | 806 | P | D | 1.56 | 0.57 | 135 | 136 |
| K116I | 116 | K | I | 1.55 | 0.44 | 137 | 138 |
| L442F | 442 | L | F | 1.55 | 0.34 | 139 | 140 |
| L301F | 301 | L | F | 1.54 | 1.32 | 141 | 142 |
| A1046C | 1046 | A | C | 1.54 | 3.27 | 143 | 144 |
| F789N | 789 | F | N | 1.54 | 0.83 | 145 | 146 |
| D283M | 283 | D | M | 1.53 | 0.18 | 147 | 148 |
| F289D | 289 | F | D | 1.53 | 0.4 | 149 | 150 |
| F1084C | 1084 | F | C | 1.52 | 0.83 | 151 | 152 |
| N1178E | 1178 | N | E | 1.5 | 0.05 | 153 | 154 |
| G146R | 146 | G | R | 1.49 | 0.02 | 155 | 156 |
| R1165E | 1165 | R | E | 1.49 | 0.05 | 157 | 158 |
| A966N | 966 | A | N | 1.48 | 0.64 | 159 | 160 |
| T814G | 814 | T | G | 1.48 | 0.05 | 161 | 162 |
| L738Y | 738 | L | Y | 1.47 | 0.47 | 163 | 164 |
| G576R | 576 | G | R | 1.47 | 0.08 | 165 | 166 |
| A375W | 375 | A | W | 1.47 | 0.35 | 167 | 168 |
| R737V | 737 | R | V | 1.47 | 0.47 | 169 | 170 |
| N238F | 238 | N | F | 1.47 | 0.23 | 171 | 172 |
| V228T | 228 | V | T | 1.46 | 0.23 | 173 | 174 |
| V24H | 24 | V | H | 1.44 | 0.25 | 175 | 176 |
| S739K | 739 | S | K | 1.43 | 0.31 | 177 | 178 |
| Y11E | 11 | Y | E | 1.42 | 0.66 | 179 | 180 |
| S445N | 445 | S | N | 1.41 | 0.33 | 181 | 182 |
| K595R | 595 | K | R | 1.4 | 0.08 | 183 | 184 |
| T307W | 307 | T | W | 1.39 | 0.22 | 185 | 186 |
| W649A | 649 | W | A | 1.39 | 1.07 | 187 | 188 |
| N772R | 772 | N | R | 1.38 | 0.44 | 189 | 190 |
| V303W | 303 | V | W | 1.38 | 0.1 | 191 | 192 |
| K725H | 725 | K | H | 1.38 | 0.21 | 193 | 194 |
| S710I | 710 | S | I | 1.38 | 1.08 | 195 | 196 |
| Y583L | 583 | Y | L | 1.38 | 0.54 | 197 | 198 |
| S465D | 465 | S | D | 1.37 | 0.11 | 199 | 200 |
| I850S | 850 | I | S | 1.37 | 0.11 | 201 | 202 |
| E743T | 743 | E | T | 1.37 | 0 | 203 | 204 |
| N575P | 575 | N | P | 1.37 | 0.09 | 205 | 206 |
| A685D | 685 | A | D | 1.37 | 0.1 | 207 | 208 |
| S763H | 763 | S | H | 1.37 | 0.14 | 209 | 210 |
| E661W | 661 | E | W | 1.37 | 0.54 | 211 | 212 |
| A1022S | 1022 | A | S | 1.37 | 0.48 | 213 | 214 |
| S388G | 388 | S | G | 1.35 | 0.15 | 215 | 216 |
| Y290M | 290 | Y | M | 1.35 | 1.03 | 217 | 218 |
| E125R | 125 | E | R | 1.34 | 0.08 | 219 | 220 |
| Q1136A | 1136 | Q | A | 1.34 | 1.93 | 221 | 222 |
| T620M | 620 | T | M | 1.34 | 0.55 | 223 | 224 |
| E1202W | 1202 | E | W | 1.33 | 0.02 | 225 | 226 |
| R305T | 305 | R | T | 1.33 | 1.2 | 227 | 228 |
| K634I | 634 | K | I | 1.33 | 1.12 | 229 | 230 |
| V938G | 938 | V | G | 1.33 | 0.44 | 231 | 232 |
| N861I | 861 | N | I | 1.32 | 0.03 | 233 | 234 |
| C175D | 175 | C | D | 1.32 | 0.44 | 235 | 236 |
| K265V | 265 | K | V | 1.32 | 0.54 | 237 | 238 |
| A1022I | 1022 | A | I | 1.32 | 0.43 | 239 | 240 |
| K464L | 464 | K | L | 1.32 | 0.55 | 241 | 242 |
| S1024E | 1024 | S | E | 1.31 | 0.31 | 243 | 244 |
| N861V | 861 | N | V | 1.31 | 0.16 | 245 | 246 |
| P799S | 799 | P | S | 1.3 | 0.05 | 247 | 248 |
| I860R | 860 | I | R | 1.29 | 0.28 | 249 | 250 |
| S750V | 750 | S | V | 1.29 | 0.05 | 251 | 252 |
| F983W | 938 | F | W | 1.27 | 1.03 | 253 | 254 |
| D384W | 384 | D | W | 1.27 | 0.06 | 255 | 256 |
| C805F | 805 | C | F | 1.27 | 0.52 | 257 | 258 |
| S282W | 282 | S | W | 1.27 | 1.52 | 259 | 260 |
| V844N | 844 | V | N | 1.27 | 0.93 | 261 | 262 |
| N864S | 864 | N | S | 1.27 | 0.05 | 263 | 264 |
| E835A | 835 | E | A | 1.26 | 0.05 | 265 | 266 |
| A920T | 920 | A | T | 1.25 | 1.43 | 267 | 268 |
| F639C | 639 | F | C | 1.25 | 0.06 | 269 | 270 |
| K953S | 953 | K | S | 1.25 | 0.41 | 271 | 272 |
| D641I | 641 | D | I | 1.25 | 0.05 | 273 | 274 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| A1122Q | 1122 | A | Q | 1.25 | 0.31 | 275 | 276 |
| L547H | 547 | L | H | 1.25 | 0.07 | 277 | 278 |
| P342L | 342 | P | L | 1.25 | 0.09 | 279 | 280 |
| F709K | 709 | F | K | 1.25 | 0.92 | 281 | 282 |
| K584E | 584 | K | E | 1.25 | 0.42 | 283 | 284 |
| Y262L | 262 | Y | L | 1.24 | 0.12 | 285 | 286 |
| D1207F | 1207 | D | F | 1.24 | 0.11 | 287 | 288 |
| M1134G | 1134 | M | G | 1.23 | 1.73 | 289 | 290 |
| V596K | 596 | V | K | 1.23 | 0.43 | 291 | 292 |
| G576M | 576 | G | M | 1.22 | 0.43 | 293 | 294 |
| L1133T | 1133 | L | T | 1.22 | 0.16 | 295 | 296 |
| K945L | 945 | K | L | 1.22 | 0.17 | 297 | 298 |
| M603Y | 603 | M | Y | 1.22 | 0.21 | 299 | 300 |
| I1211D | 1211 | I | D | 1.21 | 1.39 | 301 | 302 |
| S394Q | 394 | S | Q | 1.21 | 0.14 | 303 | 304 |
| E201I | 201 | E | I | 1.21 | 0.05 | 305 | 306 |
| S642M | 642 | S | M | 1.2 | 0.88 | 307 | 308 |
| M1137Q | 1137 | M | Q | 1.2 | 0.05 | 309 | 310 |
| Q888S | 888 | Q | S | 1.2 | 0.83 | 311 | 312 |
| R56V | 56 | R | V | 1.2 | 0.4 | 313 | 314 |
| L80D | 80 | L | D | 1.2 | 0.84 | 315 | 316 |
| S650A | 650 | S | A | 1.2 | 1.36 | 317 | 318 |
| L13C | 13 | L | C | 1.2 | 0.33 | 319 | 320 |
| Q1170D | 1170 | Q | D | 1.19 | 0.15 | 321 | 322 |
| F1198Q | 1198 | F | Q | 1.19 | 0.93 | 323 | 324 |
| F1198G | 1198 | F | G | 1.19 | 0.93 | 325 | 326 |
| F225R | 225 | F | R | 1.19 | 0.24 | 327 | 328 |
| K478W | 478 | K | W | 1.18 | 0.08 | 329 | 330 |
| I860S | 860 | I | S | 1.17 | 0.09 | 331 | 332 |
| E5Y | 5 | E | Y | 1.17 | 0.22 | 333 | 334 |
| A544T | 544 | A | T | 1.17 | 0.22 | 335 | 336 |
| N933E | 933 | N | E | 1.16 | 0.31 | 337 | 338 |
| A1129G | 1129 | A | G | 1.16 | 0.05 | 339 | 340 |
| H733K | 733 | H | K | 1.16 | 0.31 | 341 | 342 |
| D283R | 283 | D | R | 1.16 | 1.18 | 343 | 344 |
| E125S | 125 | E | S | 1.16 | 0.13 | 345 | 346 |
| N731H | 731 | N | H | 1.15 | 1.06 | 347 | 348 |
| A1129R | 1129 | A | R | 1.15 | 1.81 | 349 | 350 |
| R305D | 305 | R | D | 1.14 | 0.53 | 351 | 352 |
| K478F | 478 | K | F | 1.14 | 0.07 | 353 | 354 |
| D926Q | 926 | D | Q | 1.14 | 0.02 | 355 | 356 |
| Q231S | 231 | Q | S | 1.13 | 0.53 | 357 | 358 |
| L442C | 442 | L | C | 1.13 | 0.21 | 359 | 360 |
| L210Y | 210 | L | Y | 1.13 | 0.83 | 361 | 362 |
| S317M | 317 | S | M | 1.13 | 0.84 | 363 | 364 |
| F289Q | 289 | F | Q | 1.13 | 0.67 | 365 | 366 |
| R867Q | 867 | R | Q | 1.13 | 0.05 | 367 | 368 |
| E223L | 223 | E | L | 1.13 | 0.25 | 369 | 370 |
| E93S | 93 | E | S | 1.13 | 0.15 | 371 | 372 |
| V453R | 453 | V | R | 1.12 | 0.15 | 373 | 374 |
| L1091A | 1091 | L | A | 1.12 | 0.73 | 375 | 376 |
| L408D | 408 | L | D | 1.12 | 1.69 | 377 | 378 |
| A451K | 451 | A | K | 1.12 | 0.15 | 379 | 380 |
| G1196I | 1196 | G | I | 1.12 | 0.83 | 381 | 382 |
| K707Y | 707 | K | Y | 1.12 | 0.26 | 383 | 384 |
| F162H | 162 | F | H | 1.12 | 0.15 | 385 | 386 |
| H67G | 67 | H | G | 1.12 | 0.73 | 387 | 388 |
| E443N | 443 | E | N | 1.11 | 0.72 | 389 | 390 |
| K879D | 879 | K | D | 1.11 | 0.72 | 391 | 392 |
| Q529I | 529 | Q | I | 1.11 | 0.06 | 393 | 394 |
| H370G | 370 | H | G | 1.11 | 0.09 | 395 | 396 |
| K622P | 622 | K | P | 1.11 | 0.83 | 397 | 398 |
| D64Q | 64 | D | Q | 1.1 | 0.16 | 399 | 400 |
| F173T | 173 | F | T | 1.1 | 0.12 | 401 | 402 |
| C1090K | 1090 | C | K | 1.1 | 0.17 | 403 | 404 |
| I951S | 951 | I | S | 1.09 | 0.05 | 405 | 406 |
| V1147Y | 1147 | V | Y | 1.09 | 0.18 | 407 | 408 |
| T246V | 246 | T | V | 1.08 | 0.22 | 409 | 410 |
| D198Q | 198 | D | Q | 1.08 | 0.67 | 411 | 412 |
| K774P | 774 | K | P | 1.08 | 1.21 | 413 | 414 |
| Y11Q | 11 | Y | Q | 1.08 | 0.17 | 415 | 416 |
| T778G | 778 | T | G | 1.07 | 2.27 | 417 | 418 |
| G111Y | 111 | G | Y | 1.07 | 0.06 | 419 | 420 |
| K1210Y | 1210 | K | Y | 1.07 | 0.16 | 421 | 422 |
| E683I | 683 | E | I | 1.07 | 0.32 | 423 | 424 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
| --- | --- | --- | --- | --- | --- | --- | --- |
| R82E | 82 | R | E | 1.06 | 0.41 | 425 | 426 |
| E125K | 125 | E | N | 1.06 | 0.04 | 427 | 428 |
| S713E | 713 | S | E | 1.06 | 0.08 | 429 | 430 |
| H759G | 759 | H | G | 1.06 | 0.6 | 431 | 432 |
| E90F | 90 | E | F | 1.06 | 0.06 | 433 | 434 |
| K478L | 478 | K | L | 1.06 | 0.1 | 435 | 436 |
| K478Y | 478 | K | Y | 1.06 | 0.07 | 437 | 438 |
| A766Y | 766 | A | Y | 1.06 | 0.6 | 439 | 440 |
| E125N | 125 | E | N | 1.05 | 0.04 | 441 | 442 |
| A1194V | 1194 | A | V | 1.05 | 0.06 | 443 | 444 |
| K391F | 391 | K | F | 1.05 | 0.27 | 445 | 446 |
| K464A | 464 | K | A | 1.05 | 0.05 | 447 | 448 |
| A923G | 923 | A | G | 1.05 | 0.24 | 449 | 450 |
| Q399V | 399 | Q | V | 1.04 | 0.7 | 451 | 452 |
| R1144H | 1144 | R | H | 1.04 | 0.29 | 453 | 454 |
| N1100M | 1100 | N | M | 1.04 | 0.7 | 455 | 456 |
| F789T | 789 | F | T | 1.04 | 0.39 | 457 | 458 |
| R35G | 35 | R | G | 1.04 | 0.28 | 459 | 460 |
| W890Q | 890 | W | Q | 1.04 | 0.7 | 461 | 462 |
| A21N | 21 | A | N | 1.04 | 0.03 | 463 | 464 |
| K448Y | 448 | K | Y | 1.03 | 0.7 | 465 | 466 |
| D461L | 461 | D | L | 1.03 | 0.59 | 467 | 468 |
| T87P | 87 | T | P | 1.03 | 0.02 | 469 | 470 |
| E433H | 433 | E | H | 1.03 | 0.7 | 471 | 472 |
| K457S | 457 | K | S | 1.03 | 1.68 | 473 | 474 |
| W602Q | 602 | W | Q | 1.03 | 0.4 | 475 | 476 |
| S394C | 394 | S | C | 1.03 | 0.15 | 477 | 478 |
| S485D | 485 | S | D | 1.02 | 0.29 | 479 | 480 |
| K804Y | 804 | K | Y | 1.02 | 0.89 | 481 | 482 |
| I196K | 196 | I | K | 1.02 | 0.05 | 483 | 484 |
| K1079H | 1079 | K | H | 1.02 | 0.7 | 485 | 486 |
| L876S | 876 | L | S | 1.02 | 1.24 | 487 | 488 |
| E755S | 755 | E | S | 1.02 | 0.05 | 489 | 490 |
| I259W | 259 | I | W | 1.02 | 0.7 | 491 | 492 |
| Y1059E | 1059 | Y | E | 1.01 | 0.39 | 493 | 494 |
| T660C | 660 | T | C | 1.01 | 0.17 | 495 | 496 |
| G1196C | 1196 | G | C | 1.01 | 1.41 | 497 | 498 |
| I860E | 860 | I | E | 1.01 | 0.31 | 499 | 500 |
| A239T | 239 | A | T | 1.01 | 0.18 | 501 | 502 |
| E125A | 125 | E | A | 1 | 0.06 | 503 | 504 |
| N861T | 861 | N | T | 0.99 | 0.12 | 505 | 506 |
| I976A | 976 | I | A | 0.99 | 0.52 | 507 | 508 |
| R1073H | 1073 | R | H | 0.99 | 0.1 | 509 | 510 |
| D329F | 329 | D | F | 0.99 | 0.54 | 511 | 512 |
| K568F | 568 | K | F | 0.99 | 0.16 | 513 | 514 |
| T1142Y | 1142 | T | Y | 0.99 | 0.05 | 515 | 516 |
| R482T | 482 | R | T | 0.98 | 0.43 | 517 | 518 |
| A21F | 21 | A | F | 0.98 | 0.62 | 519 | 520 |
| K897H | 897 | K | H | 0.98 | 0.05 | 521 | 522 |
| S1020D | 1020 | S | D | 0.98 | 0.01 | 523 | 524 |
| D437I | 437 | D | I | 0.98 | 1.5 | 525 | 526 |
| K945V | 945 | K | V | 0.98 | 0.12 | 527 | 528 |
| F1099S | 1099 | F | S | 0.98 | 0.15 | 529 | 530 |
| S1020E | 1020 | S | E | 0.98 | 0.12 | 531 | 532 |
| E433Q | 433 | E | Q | 0.98 | 0.52 | 533 | 534 |
| I138Q | 138 | I | Q | 0.98 | 0.21 | 535 | 536 |
| E313C | 313 | E | C | 0.98 | 0.63 | 537 | 538 |
| N1051G | 1051 | N | G | 0.97 | 0.05 | 539 | 540 |
| W1086A | 1086 | W | A | 0.97 | 0.05 | 541 | 542 |
| M626D | 626 | M | D | 0.97 | 0.06 | 543 | 544 |
| N327E | 327 | N | E | 0.97 | 0.18 | 545 | 546 |
| C1090M | 1090 | C | M | 0.97 | 0.05 | 547 | 548 |
| I893Q | 893 | I | Q | 0.97 | 0.05 | 549 | 550 |
| S462E | 462 | S | E | 0.97 | 1.02 | 551 | 552 |
| K374P | 374 | K | P | 0.97 | 0.22 | 553 | 554 |
| G291T | 291 | G | T | 0.97 | 0.12 | 555 | 556 |
| I850Q | 850 | I | Q | 0.97 | 0.19 | 557 | 558 |
| R508G | 508 | R | G | 0.97 | 0.07 | 559 | 560 |
| H733T | 733 | H | T | 0.97 | 1.24 | 561 | 562 |
| Q1197R | 1197 | Q | R | 0.96 | 0.09 | 563 | 564 |
| E95K | 95 | E | K | 0.96 | 0.02 | 565 | 566 |
| S296L | 296 | S | L | 0.96 | 0.3 | 567 | 568 |
| A801L | 801 | A | L | 0.96 | 0.18 | 569 | 570 |
| F466A | 466 | F | A | 0.96 | 1.48 | 571 | 572 |
| K269Y | 269 | K | Y | 0.96 | 0.19 | 573 | 574 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| G576K | 576 | G | K | 0.95 | 0.3 | 575 | 576 |
| E880T | 880 | E | T | 0.95 | 0.6 | 577 | 578 |
| Q1223S | 1223 | Q | S | 0.95 | 0.1 | 579 | 580 |
| E247P | 247 | E | P | 0.95 | 0.29 | 581 | 582 |
| K774E | 774 | K | E | 0.95 | 0.86 | 583 | 584 |
| R1054F | 1054 | R | F | 0.95 | 0.38 | 585 | 586 |
| S1157M | 1157 | S | M | 0.95 | 0.01 | 587 | 588 |
| K568W | 568 | K | W | 0.95 | 0.06 | 589 | 590 |
| K1025G | 1025 | K | G | 0.94 | 0.14 | 591 | 592 |
| K478C | 478 | K | C | 0.94 | 0.1 | 593 | 594 |
| V410P | 410 | V | P | 0.94 | 0.3 | 595 | 596 |
| K1121D | 1121 | K | D | 0.94 | 0.1 | 597 | 598 |
| E285Y | 285 | E | Y | 0.94 | 0.17 | 599 | 600 |
| V428H | 428 | V | H | 0.94 | 1.52 | 601 | 602 |
| K478M | 478 | K | M | 0.93 | 0.11 | 603 | 604 |
| D1148M | 1148 | D | M | 0.93 | 0.44 | 605 | 606 |
| L914K | 914 | L | K | 0.93 | 0.18 | 607 | 608 |
| Y995L | 995 | Y | L | 0.93 | 0.05 | 609 | 610 |
| K881T | 881 | K | T | 0.93 | 3.38 | 611 | 612 |
| K120C | 120 | K | C | 0.93 | 0.54 | 613 | 614 |
| A1173D | 1173 | A | D | 0.93 | 0.11 | 615 | 616 |
| K1121E | 1121 | K | E | 0.92 | 0.08 | 617 | 618 |
| G846L | 846 | G | L | 0.92 | 0.44 | 619 | 620 |
| K478A | 478 | K | A | 0.92 | 0.08 | 621 | 622 |
| G968W | 968 | G | W | 0.92 | 0.54 | 623 | 624 |
| K1121C | 1121 | K | C | 0.92 | 0.27 | 625 | 626 |
| L140A | 140 | L | A | 0.92 | 0.44 | 627 | 628 |
| E947N | 947 | E | N | 0.92 | 0.54 | 629 | 630 |
| S934Q | 934 | S | Q | 0.92 | 0.44 | 631 | 632 |
| D771P | 771 | D | P | 0.92 | 1.06 | 633 | 634 |
| R935M | 935 | R | M | 0.92 | 0.44 | 635 | 636 |
| G624R | 624 | G | R | 0.92 | 0.55 | 637 | 638 |
| E939R | 939 | E | R | 0.92 | 0.54 | 639 | 640 |
| Y606F | 606 | Y | F | 0.92 | 0.07 | 641 | 642 |
| E88S | 88 | E | S | 0.92 | 0.04 | 643 | 644 |
| S599V | 599 | S | V | 0.92 | 0.43 | 645 | 646 |
| V441Q | 441 | V | Q | 0.92 | 1.42 | 647 | 648 |
| E1039T | 1039 | E | T | 0.92 | 0.14 | 649 | 650 |
| F473V | 473 | F | V | 0.92 | 0.06 | 651 | 652 |
| A604H | 604 | A | H | 0.92 | 0.43 | 653 | 654 |
| K326Y | 326 | K | Y | 0.92 | 0.55 | 655 | 656 |
| S855P | 855 | S | P | 0.92 | 0.54 | 657 | 658 |
| C632T | 632 | C | T | 0.92 | 0.55 | 659 | 660 |
| S686F | 686 | S | F | 0.91 | 1.41 | 661 | 662 |
| K478P | 478 | K | P | 0.91 | 0.04 | 663 | 664 |
| F597K | 597 | F | K | 0.91 | 0.56 | 665 | 666 |
| D156K | 156 | D | K | 0.91 | 0.01 | 667 | 668 |
| E852N | 852 | E | N | 0.91 | 0.67 | 669 | 670 |
| R82N | 82 | R | N | 0.91 | 0.1 | 671 | 672 |
| Q1170T | 1170 | Q | T | 0.91 | 1.25 | 673 | 674 |
| S68K | 68 | S | K | 0.91 | 0.04 | 675 | 676 |
| G740P | 740 | G | P | 0.91 | 1.52 | 677 | 678 |
| S642G | 642 | S | G | 0.91 | 0.24 | 679 | 680 |
| K1080T | 1080 | K | T | 0.91 | 3.08 | 681 | 682 |
| E683C | 683 | E | C | 0.91 | 0.43 | 683 | 684 |
| Y262P | 262 | Y | P | 0.91 | 0.44 | 685 | 686 |
| A556V | 556 | A | V | 0.9 | 1.13 | 687 | 688 |
| P1153I | 1153 | P | I | 0.9 | 0.05 | 689 | 690 |
| D495G | 495 | D | G | 0.9 | 0.05 | 691 | 692 |
| T152K | 152 | T | K | 0.9 | 0.03 | 693 | 694 |
| K269F | 269 | K | F | 0.9 | 0.1 | 695 | 696 |
| L1047K | 1047 | L | K | 0.89 | 0.1 | 697 | 698 |
| K1025P | 1025 | K | P | 0.89 | 0.06 | 699 | 700 |
| F474P | 474 | F | P | 0.89 | 0.19 | 701 | 702 |
| K561C | 561 | K | C | 0.89 | 0.55 | 703 | 704 |
| P799V | 799 | P | V | 0.89 | 0.02 | 705 | 706 |
| K326G | 326 | K | G | 0.89 | 0.11 | 707 | 708 |
| A1194C | 1194 | A | C | 0.89 | 0.9 | 709 | 710 |
| N731G | 731 | N | G | 0.88 | 0.08 | 711 | 712 |
| I841G | 841 | I | G | 0.88 | 0.13 | 713 | 714 |
| P342F | 342 | P | F | 0.88 | 0.2 | 715 | 716 |
| I860T | 860 | I | T | 0.88 | 0.1 | 717 | 718 |
| Y646H | 646 | Y | H | 0.87 | 0.01 | 719 | 720 |
| P799Y | 799 | P | Y | 0.87 | 0.18 | 721 | 722 |
| S1024D | 1024 | S | D | 0.87 | 0.08 | 723 | 724 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| K135P | 135 | K | P | 0.87 | 0.08 | 725 | 726 |
| T480D | 480 | T | D | 0.87 | 1.04 | 727 | 728 |
| L414G | 414 | L | G | 0.87 | 0.23 | 729 | 730 |
| A1057M | 1057 | A | M | 0.87 | 0.03 | 731 | 732 |
| I392D | 392 | I | D | 0.87 | 0.45 | 733 | 734 |
| K478D | 478 | K | D | 0.86 | 0.01 | 735 | 736 |
| F109R | 109 | F | R | 0.86 | 0.31 | 737 | 738 |
| P271S | 271 | P | S | 0.86 | 0.02 | 739 | 740 |
| N706F | 706 | N | F | 0.86 | 1.32 | 741 | 742 |
| A1169E | 1169 | A | E | 0.86 | 0.13 | 743 | 744 |
| D384L | 384 | D | L | 0.86 | 0.23 | 745 | 746 |
| D729C | 729 | D | C | 0.86 | 1.32 | 747 | 748 |
| S1152E | 1152 | S | E | 0.85 | 1.33 | 749 | 750 |
| F931A | 931 | F | A | 0.85 | 0.45 | 751 | 752 |
| K208S | 208 | K | S | 0.85 | 0.16 | 753 | 754 |
| D1203W | 1203 | D | W | 0.85 | 0.35 | 755 | 756 |
| K1015Y | 1015 | K | Y | 0.84 | 0.14 | 757 | 758 |
| H873W | 873 | H | W | 0.84 | 0.21 | 759 | 760 |
| R182D | 182 | R | D | 0.84 | 0.12 | 761 | 762 |
| P608N | 608 | P | N | 0.84 | 0.84 | 763 | 764 |
| E285W | 285 | E | W | 0.84 | 0.45 | 765 | 766 |
| F19D | 19 | F | D | 0.83 | 0.82 | 767 | 768 |
| K206A | 206 | K | A | 0.83 | 0.31 | 769 | 770 |
| K478Q | 478 | K | Q | 0.83 | 0.1 | 771 | 772 |
| E1202V | 1202 | E | V | 0.83 | 0.1 | 773 | 774 |
| G488T | 488 | G | T | 0.83 | 0.16 | 775 | 776 |
| S1024Y | 1024 | S | Y | 0.83 | 0.26 | 777 | 778 |
| I809C | 809 | I | C | 0.83 | 0.72 | 779 | 780 |
| D64T | 64 | D | T | 0.83 | 0.44 | 781 | 782 |
| N356W | 356 | N | W | 0.83 | 0.02 | 783 | 784 |
| D156Q | 156 | D | Q | 0.83 | 0.08 | 785 | 786 |
| I860Q | 860 | I | Q | 0.83 | 0.13 | 787 | 788 |
| L94Q | 94 | L | Q | 0.83 | 0.12 | 789 | 790 |
| K932Q | 932 | K | Q | 0.82 | 0.31 | 791 | 792 |
| N861M | 861 | N | M | 0.82 | 0.15 | 793 | 794 |
| E484L | 484 | E | L | 0.82 | 0.07 | 795 | 796 |
| E125V | 125 | E | V | 0.82 | 0.2 | 797 | 798 |
| G1069E | 1069 | G | E | 0.82 | 0.31 | 799 | 800 |
| F81E | 81 | F | E | 0.82 | 0.08 | 801 | 802 |
| K478S | 478 | K | S | 0.82 | 0.12 | 803 | 804 |
| I976Q | 976 | I | Q | 0.82 | 0.29 | 805 | 806 |
| S394L | 394 | S | L | 0.82 | 0.02 | 807 | 808 |
| E1220K | 1220 | E | K | 0.82 | 0.25 | 809 | 810 |
| G1143W | 1143 | G | W | 0.82 | 0.7 | 811 | 812 |
| A966C | 966 | A | C | 0.82 | 0.33 | 813 | 814 |
| A406R | 406 | A | R | 0.82 | 0.69 | 815 | 816 |
| K1079P | 1079 | K | P | 0.81 | 2.78 | 817 | 818 |
| K910C | 910 | K | C | 0.81 | 3.35 | 819 | 820 |
| I612R | 612 | I | R | 0.81 | 0.17 | 821 | 822 |
| N179F | 179 | N | F | 0.81 | 0.23 | 823 | 824 |
| E125C | 125 | E | C | 0.81 | 0.07 | 825 | 826 |
| G111Q | 111 | G | Q | 0.81 | 0.17 | 827 | 828 |
| L779W | 779 | L | W | 0.81 | 0.06 | 829 | 830 |
| D501V | 501 | D | V | 0.8 | 0.67 | 831 | 832 |
| L839F | 839 | L | F | 0.8 | 0.18 | 833 | 834 |
| F1198A | 1198 | F | A | 0.8 | 0.32 | 835 | 836 |
| L255W | 255 | L | W | 0.8 | 0.18 | 837 | 838 |
| E204S | 204 | E | S | 0.8 | 0.05 | 839 | 840 |
| F81T | 81 | F | T | 0.8 | 0.24 | 841 | 842 |
| E125T | 125 | E | T | 0.8 | 0.07 | 843 | 844 |
| S684L | 684 | S | L | 0.8 | 0.22 | 845 | 846 |
| K253H | 253 | K | H | 0.8 | 0.06 | 847 | 848 |
| R867H | 867 | R | H | 0.79 | 0.05 | 849 | 850 |
| E433W | 433 | E | W | 0.79 | 0.05 | 851 | 852 |
| S790F | 790 | S | F | 0.79 | 0.55 | 853 | 854 |
| G114Y | 114 | G | Y | 0.79 | 0.23 | 855 | 856 |
| P806M | 806 | P | M | 0.79 | 0.06 | 857 | 858 |
| A404N | 404 | A | N | 0.79 | 0.24 | 859 | 860 |
| Y294E | 294 | Y | E | 0.79 | 0.05 | 861 | 862 |
| Q264S | 264 | Q | S | 0.79 | 0.05 | 863 | 864 |
| S185L | 185 | S | L | 0.79 | 0.06 | 865 | 866 |
| N306C | 306 | N | C | 0.79 | 0.35 | 867 | 868 |
| Q399D | 399 | Q | D | 0.79 | 0.24 | 869 | 870 |
| Y426Q | 426 | Y | Q | 0.79 | 0.08 | 871 | 872 |
| L435I | 435 | L | I | 0.79 | 0.27 | 873 | 874 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| N861L | 861 | N | L | 0.79 | 0.02 | 875 | 876 |
| V942I | 942 | V | I | 0.79 | 0.34 | 877 | 878 |
| E981V | 981 | E | V | 0.79 | 0.03 | 879 | 880 |
| K698C | 698 | K | C | 0.79 | 0.23 | 881 | 882 |
| R1138T | 1138 | R | T | 0.78 | 0.24 | 883 | 884 |
| L301C | 301 | L | C | 0.78 | 0.61 | 885 | 886 |
| N327Y | 327 | N | Y | 0.78 | 0.23 | 887 | 888 |
| L899K | 899 | L | K | 0.78 | 0.23 | 889 | 890 |
| G991T | 991 | G | T | 0.78 | 0.23 | 891 | 892 |
| V851H | 851 | V | H | 0.78 | 0.34 | 893 | 894 |
| G1103K | 1103 | G | K | 0.78 | 0.34 | 895 | 896 |
| G1009L | 1009 | G | L | 0.78 | 0.23 | 897 | 898 |
| S317P | 317 | S | P | 0.78 | 0.23 | 899 | 900 |
| S934A | 934 | S | A | 0.78 | 0.34 | 901 | 902 |
| E852K | 852 | E | K | 0.78 | 0.23 | 903 | 904 |
| A108Y | 108 | A | Y | 0.78 | 0.34 | 905 | 906 |
| I860K | 860 | I | K | 0.78 | 0.15 | 907 | 908 |
| E939V | 939 | E | V | 0.78 | 0.24 | 909 | 910 |
| W999T | 999 | W | T | 0.78 | 1.32 | 911 | 912 |
| D188M | 188 | D | M | 0.78 | 0.24 | 913 | 914 |
| S1152D | 1152 | S | D | 0.78 | 1.22 | 915 | 916 |
| G335N | 335 | G | N | 0.78 | 0.23 | 917 | 918 |
| R158A | 158 | R | A | 0.78 | 0.23 | 919 | 920 |
| S905Q | 905 | S | Q | 0.77 | 0.23 | 921 | 922 |
| N1186E | 1186 | N | E | 0.77 | 0.33 | 923 | 924 |
| K979I | 979 | K | I | 0.77 | 0.34 | 925 | 926 |
| H633I | 633 | H | I | 0.77 | 0.34 | 927 | 928 |
| E795Q | 795 | E | Q | 0.77 | 0.09 | 929 | 930 |
| V38E | 38 | V | E | 0.77 | 0.09 | 931 | 932 |
| Y616V | 616 | Y | V | 0.77 | 0.34 | 933 | 934 |
| I809N | 809 | I | N | 0.77 | 0.23 | 935 | 936 |
| G488K | 488 | G | K | 0.77 | 0.23 | 937 | 938 |
| A1194R | 1194 | A | R | 0.77 | 1.31 | 939 | 940 |
| A364W | 364 | A | W | 0.77 | 0.23 | 941 | 942 |
| K1199F | 1199 | K | F | 0.77 | 0.74 | 943 | 944 |
| F227N | 227 | F | N | 0.77 | 0.66 | 945 | 946 |
| N1166E | 1166 | N | E | 0.77 | 0.15 | 947 | 948 |
| V511H | 511 | V | H | 0.77 | 0.22 | 949 | 950 |
| E292N | 292 | E | N | 0.77 | 0.34 | 951 | 952 |
| V491D | 491 | V | D | 0.77 | 0.1 | 953 | 954 |
| R1071V | 1071 | R | V | 0.77 | 0.34 | 955 | 956 |
| G477P | 477 | G | P | 0.76 | 0.02 | 957 | 958 |
| K688D | 688 | K | D | 0.76 | 0.1 | 959 | 960 |
| A506L | 506 | A | L | 0.76 | 1.33 | 961 | 962 |
| K310I | 310 | K | I | 0.76 | 0.34 | 963 | 964 |
| S288Q | 288 | S | Q | 0.76 | 2.07 | 965 | 966 |
| S394V | 394 | S | V | 0.76 | 0.08 | 967 | 968 |
| V673W | 673 | V | W | 0.76 | 0.23 | 969 | 970 |
| D641Q | 641 | D | Q | 0.76 | 0.23 | 971 | 972 |
| F227A | 227 | F | A | 0.76 | 0.33 | 973 | 974 |
| Y646W | 646 | Y | W | 0.76 | 0.12 | 975 | 976 |
| T977I | 977 | T | I | 0.76 | 0.21 | 977 | 978 |
| D156M | 156 | D | M | 0.76 | 0.2 | 979 | 980 |
| A1022R | 1022 | A | R | 0.76 | 0.98 | 981 | 982 |
| D1207S | 1207 | D | S | 0.76 | 0.01 | 983 | 984 |
| E947R | 947 | E | R | 0.76 | 0.07 | 985 | 986 |
| I841A | 841 | I | A | 0.76 | 0.03 | 987 | 988 |
| F466R | 466 | F | R | 0.76 | 0.14 | 989 | 990 |
| K20R | 20 | K | R | 0.75 | 0.12 | 991 | 992 |
| Y1106Q | 1106 | Y | Q | 0.75 | 1.22 | 993 | 994 |
| N1100D | 1100 | N | D | 0.75 | 0.22 | 995 | 996 |
| T814K | 814 | T | K | 0.75 | 0.1 | 997 | 998 |
| S286Q | 286 | S | Q | 0.75 | 1.19 | 999 | 1000 |
| T8A | 8 | T | A | 0.75 | 0.26 | 1001 | 1002 |
| E939K | 939 | E | K | 0.75 | 0.29 | 1003 | 1004 |
| A761Y | 761 | A | Y | 0.75 | 0.02 | 1005 | 1006 |
| Q1170F | 1170 | Q | F | 0.75 | 0.02 | 1007 | 1008 |
| Y974G | 974 | Y | G | 0.75 | 0.14 | 1009 | 1010 |
| A1129Q | 1129 | A | Q | 0.75 | 0.25 | 1011 | 1012 |
| D665N | 665 | D | N | 0.74 | 0.09 | 1013 | 1014 |
| D559A | 559 | D | A | 0.74 | 0.22 | 1015 | 1016 |
| K1025C | 1025 | K | C | 0.74 | 0.04 | 1017 | 1018 |
| K561I | 561 | K | I | 0.74 | 0.22 | 1019 | 1020 |
| E1044L | 1044 | E | L | 0.74 | 0.13 | 1021 | 1022 |
| M1128S | 1128 | M | S | 0.74 | 0.06 | 1023 | 1024 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| I62A | 62 | I | A | 0.74 | 0.33 | 1025 | 1026 |
| R482D | 482 | R | D | 0.74 | 0.05 | 1027 | 1028 |
| K687G | 687 | K | G | 0.74 | 0.23 | 1029 | 1030 |
| K879L | 879 | K | L | 0.74 | 0.14 | 1031 | 1032 |
| L4N | 4 | L | N | 0.74 | 0.31 | 1033 | 1034 |
| K478G | 478 | K | G | 0.74 | 0.07 | 1035 | 1036 |
| E88A | 88 | E | A | 0.74 | 0.18 | 1037 | 1038 |
| R182L | 182 | R | L | 0.74 | 0.04 | 1039 | 1040 |
| R1165L | 1165 | R | L | 0.74 | 1.26 | 1041 | 1042 |
| V1154P | 1154 | V | P | 0.74 | 0.05 | 1043 | 1044 |
| A685M | 685 | A | M | 0.74 | 0.03 | 1045 | 1046 |
| L875H | 875 | L | H | 0.73 | 1.26 | 1047 | 1048 |
| G475I | 475 | G | I | 0.73 | 0.08 | 1049 | 1050 |
| N1081Q | 1081 | N | Q | 0.73 | 0.17 | 1051 | 1052 |
| F655D | 655 | F | D | 0.73 | 1.32 | 1053 | 1054 |
| K1015F | 1015 | K | F | 0.73 | 0.06 | 1055 | 1056 |
| E125M | 125 | E | M | 0.73 | 0.2 | 1057 | 1058 |
| F337T | 337 | F | T | 0.73 | 0.1 | 1059 | 1060 |
| Y549G | 549 | Y | G | 0.73 | 0.09 | 1061 | 1062 |
| R182P | 182 | R | P | 0.73 | 0.07 | 1063 | 1064 |
| S409N | 409 | S | N | 0.73 | 0.26 | 1065 | 1066 |
| K937V | 937 | K | V | 0.73 | 0.25 | 1067 | 1068 |
| I344G | 344 | I | G | 0.73 | 0.09 | 1069 | 1070 |
| K1015D | 1015 | K | D | 0.72 | 0.08 | 1071 | 1072 |
| T778R | 778 | T | R | 0.72 | 0.34 | 1073 | 1074 |
| F19E | 19 | F | E | 0.72 | 0.32 | 1075 | 1076 |
| N577E | 577 | N | E | 0.72 | 0.16 | 1077 | 1078 |
| K478V | 478 | K | V | 0.72 | 0.06 | 1079 | 1080 |
| T378G | 378 | T | G | 0.72 | 0.66 | 1081 | 1082 |
| K478T | 478 | K | T | 0.72 | 0.12 | 1083 | 1084 |
| D654M | 654 | D | M | 0.72 | 1.15 | 1085 | 1086 |
| R1033G | 1033 | R | G | 0.72 | 0.26 | 1087 | 1088 |
| E858Y | 858 | E | Y | 0.72 | 0.08 | 1089 | 1090 |
| I866R | 866 | I | R | 0.72 | 0.65 | 1091 | 1092 |
| E95S | 95 | E | S | 0.72 | 0.03 | 1093 | 1094 |
| K434T | 434 | K | T | 0.71 | 2.2 | 1095 | 1096 |
| F81D | 81 | F | D | 0.71 | 0.06 | 1097 | 1098 |
| M456L | 456 | M | L | 0.71 | 0.09 | 1099 | 1100 |
| S780V | 780 | S | V | 0.71 | 0.32 | 1101 | 1102 |
| I369D | 369 | I | D | 0.71 | 0.24 | 1103 | 1104 |
| V1083S | 1083 | V | S | 0.71 | 0.19 | 1105 | 1106 |
| L555I | 555 | L | I | 0.71 | 0.06 | 1107 | 1108 |
| K1096Q | 1096 | K | Q | 0.7 | 0.65 | 1109 | 1110 |
| R482Q | 482 | R | Q | 0.7 | 0.01 | 1111 | 1112 |
| A742W | 742 | A | W | 0.7 | 0.55 | 1113 | 1114 |
| K1121I | 1121 | K | I | 0.7 | 0.08 | 1115 | 1116 |
| S644R | 644 | S | R | 0.7 | 0.7 | 1117 | 1118 |
| K1096F | 1096 | K | F | 0.7 | 0.36 | 1119 | 1120 |
| N306E | 306 | N | E | 0.7 | 0.36 | 1121 | 1122 |
| N306G | 306 | N | G | 0.7 | 1.2 | 1123 | 1124 |
| Q401V | 401 | Q | V | 0.7 | 0.13 | 1125 | 1126 |
| G393P | 393 | G | P | 0.7 | 0.21 | 1127 | 1128 |
| F197H | 197 | F | H | 0.7 | 0.1 | 1129 | 1130 |
| K948E | 948 | K | E | 0.7 | 0.12 | 1131 | 1132 |
| T346Q | 346 | T | Q | 0.69 | 1.2 | 1133 | 1134 |
| N263W | 263 | N | W | 0.69 | 0.05 | 1135 | 1136 |
| D156T | 156 | D | T | 0.69 | 0.05 | 1137 | 1138 |
| G293P | 293 | G | P | 0.69 | 0.1 | 1139 | 1140 |
| D782M | 782 | D | M | 0.69 | 0.06 | 1141 | 1142 |
| F119K | 119 | F | K | 0.69 | 1.18 | 1143 | 1144 |
| K415A | 415 | K | A | 0.69 | 1.19 | 1145 | 1146 |
| R1138Q | 1138 | R | Q | 0.69 | 0.21 | 1147 | 1148 |
| K1101E | 1101 | K | E | 0.69 | 1.09 | 1149 | 1150 |
| Y1018R | 1018 | Y | R | 0.69 | 1.24 | 1151 | 1152 |
| N1105S | 1105 | N | S | 0.69 | 0.2 | 1153 | 1154 |
| A375Y | 375 | A | Y | 0.69 | 0.1 | 1155 | 1156 |
| S312Y | 312 | S | Y | 0.69 | 1.2 | 1157 | 1158 |
| R182Q | 182 | R | Q | 0.69 | 0.05 | 1159 | 1160 |
| L446K | 446 | L | K | 0.69 | 0.21 | 1161 | 1162 |
| I205E | 205 | I | E | 0.69 | 1.09 | 1163 | 1164 |
| V300K | 300 | V | K | 0.69 | 0.21 | 1165 | 1166 |
| G1103A | 1103 | G | A | 0.69 | 0.11 | 1167 | 1168 |
| V921M | 921 | V | M | 0.69 | 1.19 | 1169 | 1170 |
| K208A | 208 | K | A | 0.69 | 0.21 | 1171 | 1172 |
| K274G | 274 | K | G | 0.69 | 0.09 | 1173 | 1174 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| W1063N | 1063 | W | N | 0.69 | 0.06 | 1175 | 1176 |
| E852T | 852 | E | T | 0.68 | 0.17 | 1177 | 1178 |
| S609D | 609 | S | D | 0.68 | 0.09 | 1179 | 1180 |
| T295V | 295 | T | V | 0.68 | 0.22 | 1181 | 1182 |
| T1019E | 1019 | T | E | 0.68 | 0.07 | 1183 | 1184 |
| L586T | 586 | L | T | 0.68 | 0.22 | 1185 | 1186 |
| M187D | 187 | M | D | 0.68 | 0.04 | 1187 | 1188 |
| Q567C | 567 | Q | C | 0.68 | 0.03 | 1189 | 1190 |
| E298A | 298 | E | A | 0.68 | 1.19 | 1191 | 1192 |
| E925R | 925 | E | R | 0.68 | 0.4 | 1193 | 1194 |
| P342E | 342 | P | E | 0.68 | 0.12 | 1195 | 1196 |
| Y1049I | 1049 | Y | I | 0.68 | 0.1 | 1197 | 1198 |
| G1183P | 1183 | G | P | 0.68 | 1.18 | 1199 | 1200 |
| I798C | 798 | I | C | 0.68 | 0.36 | 1201 | 1202 |
| L738R | 738 | L | R | 0.68 | 0.39 | 1203 | 1204 |
| K478I | 478 | K | I | 0.68 | 0.09 | 1205 | 1206 |
| F682A | 682 | F | A | 0.68 | 0.62 | 1207 | 1208 |
| S1024P | 1024 | S | P | 0.68 | 0.14 | 1209 | 1210 |
| D832S | 832 | D | S | 0.68 | 0.43 | 1211 | 1212 |
| K390S | 390 | K | S | 0.68 | 0.06 | 1213 | 1214 |
| F655N | 655 | F | N | 0.67 | 0.26 | 1215 | 1216 |
| P647Y | 647 | P | Y | 0.67 | 1.19 | 1217 | 1218 |
| L914T | 914 | L | T | 0.67 | 0.66 | 1219 | 1220 |
| S1157Q | 1157 | S | Q | 0.67 | 0.41 | 1221 | 1222 |
| N928V | 928 | N | V | 0.67 | 0.09 | 1223 | 1224 |
| F525N | 525 | F | N | 0.67 | 0.09 | 1225 | 1226 |
| E858L | 858 | E | L | 0.67 | 0.15 | 1227 | 1228 |
| N656F | 656 | N | F | 0.67 | 0.21 | 1229 | 1230 |
| K272W | 272 | K | W | 0.67 | 0.11 | 1231 | 1232 |
| K444G | 444 | K | G | 0.67 | 0.08 | 1233 | 1234 |
| G902M | 902 | G | M | 0.67 | 0.17 | 1235 | 1236 |
| I1195K | 1195 | I | K | 0.67 | 0.09 | 1237 | 1238 |
| S1029K | 1029 | S | K | 0.67 | 0.37 | 1239 | 1240 |
| D156S | 156 | D | S | 0.66 | 0.09 | 1241 | 1242 |
| L727S | 727 | L | S | 0.66 | 0.49 | 1243 | 1244 |
| Y562E | 562 | Y | E | 0.66 | 0.24 | 1245 | 1246 |
| F884T | 884 | F | T | 0.66 | 0.72 | 1247 | 1248 |
| T967C | 967 | T | C | 0.66 | 2.42 | 1249 | 1250 |
| V280T | 280 | V | T | 0.66 | 2.72 | 1251 | 1252 |
| N861F | 861 | N | F | 0.66 | 0.16 | 1253 | 1254 |
| S143L | 143 | S | L | 0.65 | 0.25 | 1255 | 1256 |
| S1020C | 1020 | S | C | 0.65 | 0.94 | 1257 | 1258 |
| S394W | 394 | S | W | 0.65 | 0.08 | 1259 | 1260 |
| D537C | 537 | D | C | 0.65 | 1.19 | 1261 | 1262 |
| G624C | 624 | G | C | 0.65 | 0.38 | 1263 | 1264 |
| F289A | 289 | F | A | 0.65 | 0.06 | 1265 | 1266 |
| K92R | 92 | K | R | 0.65 | 0.16 | 1267 | 1268 |
| V24Q | 24 | V | Q | 0.65 | 0.12 | 1269 | 1270 |
| I798S | 798 | I | S | 0.65 | 0.06 | 1271 | 1272 |
| N179Q | 179 | N | Q | 0.65 | 0.03 | 1273 | 1274 |
| I241D | 241 | I | D | 0.65 | 1.08 | 1275 | 1276 |
| E217G | 217 | E | G | 0.65 | 0.21 | 1277 | 1278 |
| R182C | 182 | R | C | 0.65 | 0.13 | 1279 | 1280 |
| N849R | 849 | N | R | 0.65 | 0.44 | 1281 | 1282 |
| R1138M | 1138 | R | M | 0.65 | 0.15 | 1283 | 1284 |
| N577W | 577 | N | W | 0.65 | 0.05 | 1285 | 1286 |
| K1025Y | 1025 | K | Y | 0.65 | 0.64 | 1287 | 1288 |
| T480V | 480 | T | V | 0.65 | 0.07 | 1289 | 1290 |
| I1195G | 1195 | I | G | 0.65 | 0.16 | 1291 | 1292 |
| M986C | 986 | M | C | 0.65 | 0.54 | 1293 | 1294 |
| V411Q | 411 | V | Q | 0.64 | 0.54 | 1295 | 1296 |
| L914G | 914 | L | G | 0.64 | 0.23 | 1297 | 1298 |
| K274T | 274 | K | T | 0.64 | 0.04 | 1299 | 1300 |
| V758W | 758 | V | W | 0.64 | 0.08 | 1301 | 1302 |
| F745N | 745 | F | N | 0.64 | 1.12 | 1303 | 1304 |
| L94H | 94 | L | H | 0.64 | 0.54 | 1305 | 1306 |
| S905C | 905 | S | C | 0.64 | 0.03 | 1307 | 1308 |
| K310D | 310 | K | D | 0.64 | 0.72 | 1309 | 1310 |
| S465Q | 465 | S | Q | 0.64 | 0.1 | 1311 | 1312 |
| F931V | 931 | F | V | 0.64 | 0.17 | 1313 | 1314 |
| P342W | 342 | P | W | 0.64 | 0.02 | 1315 | 1316 |
| P589Y | 589 | P | Y | 0.64 | 0.64 | 1317 | 1318 |
| K1155V | 1155 | K | V | 0.64 | 0.06 | 1319 | 1320 |
| P806H | 806 | P | H | 0.64 | 0.41 | 1321 | 1322 |
| K269S | 269 | K | S | 0.64 | 0.07 | 1323 | 1324 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| I124N | 124 | I | N | 0.64 | 0.44 | 1325 | 1326 |
| E416P | 416 | E | P | 0.64 | 0.7 | 1327 | 1328 |
| P799C | 799 | P | C | 0.63 | 0.04 | 1329 | 1330 |
| V958M | 958 | V | M | 0.63 | 0.25 | 1331 | 1332 |
| N263L | 263 | N | L | 0.63 | 0.55 | 1333 | 1334 |
| F1045N | 1045 | F | N | 0.63 | 0.03 | 1335 | 1336 |
| K1015M | 1015 | K | M | 0.63 | 0.06 | 1337 | 1338 |
| N30Y | 30 | N | Y | 0.63 | 0.04 | 1339 | 1340 |
| L593T | 593 | L | T | 0.63 | 0.64 | 1341 | 1342 |
| E412C | 412 | E | C | 0.63 | 0.12 | 1343 | 1344 |
| E852W | 852 | E | W | 0.63 | 0.39 | 1345 | 1346 |
| P515C | 515 | P | C | 0.63 | 0.28 | 1347 | 1348 |
| K26C | 26 | K | C | 0.63 | 1.1 | 1349 | 1350 |
| A1201G | 1201 | A | G | 0.63 | 0.54 | 1351 | 1352 |
| S14V | 14 | S | V | 0.63 | 0.06 | 1353 | 1354 |
| V428Y | 428 | V | Y | 0.63 | 0.27 | 1355 | 1356 |
| K269A | 269 | K | A | 0.63 | 0.16 | 1357 | 1358 |
| E98H | 98 | E | H | 0.63 | 0.05 | 1359 | 1360 |
| N226T | 226 | N | T | 0.63 | 0.35 | 1361 | 1362 |
| I868L | 868 | I | L | 0.63 | 0.03 | 1363 | 1364 |
| N864L | 864 | N | L | 0.63 | 0.54 | 1365 | 1366 |
| E39I | 39 | E | I | 0.63 | 0.09 | 1367 | 1368 |
| G1159I | 1159 | G | I | 0.63 | 0.38 | 1369 | 1370 |
| M1134S | 1134 | M | S | 0.63 | 1.32 | 1371 | 1372 |
| Y616E | 616 | Y | E | 0.63 | 0.03 | 1373 | 1374 |
| V491N | 491 | V | N | 0.63 | 0.16 | 1375 | 1376 |
| E178I | 178 | E | I | 0.63 | 0.44 | 1377 | 1378 |
| I1034E | 1034 | I | E | 0.63 | 0.08 | 1379 | 1380 |
| T777L | 777 | T | L | 0.63 | 0.34 | 1381 | 1382 |
| L180E | 180 | L | E | 0.63 | 0.24 | 1383 | 1384 |
| T814L | 814 | T | L | 0.63 | 0.05 | 1385 | 1386 |
| V511S | 511 | V | S | 0.62 | 0.42 | 1387 | 1388 |
| L210K | 210 | L | K | 0.62 | 0.2 | 1389 | 1390 |
| Y469A | 469 | Y | A | 0.62 | 0.08 | 1391 | 1392 |
| F273P | 273 | F | P | 0.62 | 0.23 | 1393 | 1394 |
| S163D | 163 | S | D | 0.62 | 0.59 | 1395 | 1396 |
| G1196S | 1196 | G | S | 0.62 | 0.38 | 1397 | 1398 |
| N33W | 33 | N | W | 0.62 | 0.06 | 1399 | 1400 |
| K591H | 591 | K | H | 0.62 | 0.64 | 1401 | 1402 |
| K688S | 688 | K | S | 0.62 | 0.08 | 1403 | 1404 |
| I996M | 996 | I | M | 0.62 | 0.01 | 1405 | 1406 |
| V851R | 851 | V | R | 0.62 | 0.1 | 1407 | 1408 |
| E913Y | 913 | E | Y | 0.62 | 0.74 | 1409 | 1410 |
| K478N | 478 | K | N | 0.62 | 0.05 | 1411 | 1412 |
| D156C | 156 | D | C | 0.62 | 0.17 | 1413 | 1414 |
| K536R | 536 | K | R | 0.62 | 0.01 | 1415 | 1416 |
| K688P | 688 | K | P | 0.62 | 0.08 | 1417 | 1418 |
| V758Q | 758 | V | Q | 0.62 | 0.05 | 1419 | 1420 |
| E125Q | 125 | E | Q | 0.61 | 0.03 | 1421 | 1422 |
| S739I | 739 | S | I | 0.61 | 0.44 | 1423 | 1424 |
| R35A | 35 | R | A | 0.61 | 0.28 | 1425 | 1426 |
| D823M | 823 | D | M | 0.61 | 0.45 | 1427 | 1428 |
| T1019D | 1019 | T | D | 0.61 | 0.03 | 1429 | 1430 |
| P1153L | 1153 | P | L | 0.61 | 0.05 | 1431 | 1432 |
| K1025A | 1025 | K | A | 0.61 | 0.15 | 1433 | 1434 |
| E795L | 795 | E | L | 0.61 | 0.05 | 1435 | 1436 |
| F1043C | 1043 | F | C | 0.61 | 0.01 | 1437 | 1438 |
| V491H | 491 | V | H | 0.61 | 0.17 | 1439 | 1440 |
| E165N | 165 | E | N | 0.61 | 0.28 | 1441 | 1442 |
| P799K | 799 | P | K | 0.61 | 0.09 | 1443 | 1444 |
| D46R | 46 | D | R | 0.61 | 0.01 | 1445 | 1446 |
| A685Q | 685 | A | Q | 0.61 | 0.03 | 1447 | 1448 |
| Y781E | 781 | Y | E | 0.6 | 0.26 | 1449 | 1450 |
| N30F | 30 | N | F | 0.6 | 0.02 | 1451 | 1452 |
| N1070R | 1070 | N | R | 0.6 | 0.01 | 1453 | 1454 |
| P806E | 806 | P | E | 0.6 | 0.5 | 1455 | 1456 |
| E913N | 913 | E | N | 0.6 | 0.05 | 1457 | 1458 |
| Y1018Q | 1018 | Y | Q | 0.6 | 0.54 | 1459 | 1460 |
| L751C | 751 | L | C | 0.6 | 0.57 | 1461 | 1462 |
| G588Y | 588 | G | Y | 0.6 | 0.36 | 1463 | 1464 |
| L927D | 927 | L | D | 0.6 | 0.16 | 1465 | 1466 |
| K984A | 984 | K | A | 0.6 | 0.22 | 1467 | 1468 |
| I1141R | 1141 | I | R | 0.6 | 0.11 | 1469 | 1470 |
| R86F | 86 | R | F | 0.6 | 0.11 | 1471 | 1472 |
| G49C | 49 | G | C | 0.6 | 0.19 | 1473 | 1474 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| E207P | 207 | E | P | 0.59 | 0.34 | 1475 | 1476 |
| K1121P | 1121 | K | P | 0.59 | 0.15 | 1477 | 1478 |
| A1212G | 1212 | A | G | 0.59 | 0.09 | 1479 | 1480 |
| E479C | 479 | E | C | 0.59 | 0 | 1481 | 1482 |
| G49T | 49 | G | T | 0.59 | 0.45 | 1483 | 1484 |
| Y381M | 381 | Y | M | 0.59 | 0.07 | 1485 | 1486 |
| D156I | 156 | D | I | 0.59 | 0.11 | 1487 | 1488 |
| K421S | 421 | K | S | 0.59 | 0.18 | 1489 | 1490 |
| L308C | 308 | L | C | 0.59 | 0.03 | 1491 | 1492 |
| K1177Q | 1177 | K | Q | 0.59 | 0.1 | 1493 | 1494 |
| Y854R | 854 | Y | R | 0.59 | 0.12 | 1495 | 1496 |
| S394F | 394 | S | F | 0.59 | 0.93 | 1497 | 1498 |
| K272G | 272 | K | G | 0.59 | 0.08 | 1499 | 1500 |
| V357E | 357 | V | E | 0.59 | 0.15 | 1501 | 1502 |
| E39Q | 39 | E | Q | 0.59 | 0.15 | 1503 | 1504 |
| D654K | 654 | D | K | 0.59 | 0.33 | 1505 | 1506 |
| K1121V | 1121 | K | V | 0.59 | 0.02 | 1507 | 1508 |
| H759F | 759 | H | F | 0.59 | 0.29 | 1509 | 1510 |
| Y516G | 516 | Y | G | 0.59 | 0.41 | 1511 | 1512 |
| S117T | 117 | S | T | 0.59 | 0.05 | 1513 | 1514 |
| L756K | 756 | L | K | 0.59 | 0.05 | 1515 | 1516 |
| A685L | 685 | A | L | 0.58 | 0.2 | 1517 | 1518 |
| A652V | 652 | A | V | 0.58 | 0.69 | 1519 | 1520 |
| K568P | 568 | K | P | 0.58 | 0.11 | 1521 | 1522 |
| F474T | 474 | F | T | 0.58 | 0.07 | 1523 | 1524 |
| D729Y | 729 | D | Y | 0.58 | 0.52 | 1525 | 1526 |
| I860G | 860 | I | G | 0.58 | 0.16 | 1527 | 1528 |
| L400D | 400 | L | D | 0.58 | 0.05 | 1529 | 1530 |
| G1143I | 1143 | G | I | 0.58 | 0.05 | 1531 | 1532 |
| E898A | 898 | E | A | 0.58 | 0.05 | 1533 | 1534 |
| D194H | 194 | D | H | 0.58 | 0.93 | 1535 | 1536 |
| G1143R | 1143 | G | R | 0.58 | 0.02 | 1537 | 1538 |
| K1205Y | 1205 | K | Y | 0.58 | 0.05 | 1539 | 1540 |
| T307G | 307 | T | G | 0.58 | 0.06 | 1541 | 1542 |
| A970K | 970 | A | K | 0.58 | 0.93 | 1543 | 1544 |
| V1089Q | 1089 | V | Q | 0.58 | 0.05 | 1545 | 1546 |
| F273A | 273 | F | A | 0.58 | 0.07 | 1547 | 1548 |
| V842T | 842 | V | T | 0.58 | 0.4 | 1549 | 1550 |
| F702K | 702 | F | K | 0.58 | 0.06 | 1551 | 1552 |
| A406K | 406 | A | K | 0.58 | 0.25 | 1553 | 1554 |
| S212K | 212 | S | K | 0.58 | 0.05 | 1555 | 1556 |
| S143A | 143 | S | A | 0.58 | 0 | 1557 | 1558 |
| K514H | 514 | K | H | 0.58 | 0.07 | 1559 | 1560 |
| H759W | 759 | H | W | 0.58 | 0.26 | 1561 | 1562 |
| A1046R | 1046 | A | R | 0.58 | 0.06 | 1563 | 1564 |
| S431W | 431 | S | W | 0.58 | 0.05 | 1565 | 1566 |
| R174F | 174 | R | F | 0.58 | 0.93 | 1567 | 1568 |
| K116E | 116 | K | E | 0.58 | 0.05 | 1569 | 1570 |
| E223R | 223 | E | R | 0.58 | 0.93 | 1571 | 1572 |
| F1043G | 1043 | F | G | 0.58 | 0.06 | 1573 | 1574 |
| L856Y | 856 | L | Y | 0.58 | 0.05 | 1575 | 1576 |
| K267S | 267 | K | S | 0.58 | 0.05 | 1577 | 1578 |
| K522L | 522 | K | L | 0.58 | 0.91 | 1579 | 1580 |
| A172H | 172 | A | H | 0.58 | 0.05 | 1581 | 1582 |
| N263E | 263 | N | E | 0.57 | 0.05 | 1583 | 1584 |
| F931R | 931 | F | R | 0.57 | 0.05 | 1585 | 1586 |
| K910E | 910 | K | E | 0.57 | 0.33 | 1587 | 1588 |
| D708L | 708 | D | L | 0.57 | 0.06 | 1589 | 1590 |
| E674M | 674 | E | M | 0.57 | 0.19 | 1591 | 1592 |
| I860H | 860 | I | H | 0.57 | 0.05 | 1593 | 1594 |
| K107D | 107 | K | D | 0.57 | 0.19 | 1595 | 1596 |
| L1091Y | 1091 | L | Y | 0.57 | 1.03 | 1597 | 1598 |
| E1044Y | 1044 | E | Y | 0.57 | 0.06 | 1599 | 1600 |
| E137L | 137 | E | L | 0.57 | 0.62 | 1601 | 1602 |
| F131P | 131 | F | P | 0.57 | 0.93 | 1603 | 1604 |
| L914H | 914 | L | H | 0.57 | 0.93 | 1605 | 1606 |
| L839T | 839 | L | T | 0.57 | 0.08 | 1607 | 1608 |
| T1019K | 1019 | T | K | 0.57 | 1.03 | 1609 | 1610 |
| T1019R | 1019 | T | R | 0.57 | 1.03 | 1611 | 1612 |
| L459D | 459 | L | D | 0.57 | 0.93 | 1613 | 1614 |
| F304N | 304 | F | N | 0.57 | 0.06 | 1615 | 1616 |
| N238L | 238 | N | L | 0.57 | 0.05 | 1617 | 1618 |
| Q1136M | 1136 | Q | M | 0.57 | 0.29 | 1619 | 1620 |
| I1021R | 1021 | I | R | 0.57 | 1.39 | 1621 | 1622 |
| K167T | 167 | K | T | 0.57 | 0.05 | 1623 | 1624 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| T181H | 181 | T | H | 0.57 | 0.05 | 1625 | 1626 |
| K972R | 972 | K | R | 0.57 | 0.08 | 1627 | 1628 |
| N1186M | 1186 | N | M | 0.57 | 1.03 | 1629 | 1630 |
| K457I | 457 | K | I | 0.57 | 0.05 | 1631 | 1632 |
| K457M | 457 | K | M | 0.57 | 0.93 | 1633 | 1634 |
| S445E | 445 | S | E | 0.57 | 0.19 | 1635 | 1636 |
| L324I | 324 | L | I | 0.57 | 0.16 | 1637 | 1638 |
| D871A | 871 | D | A | 0.57 | 0.05 | 1639 | 1640 |
| D450C | 450 | D | C | 0.57 | 1.03 | 1641 | 1642 |
| Q231P | 231 | Q | P | 0.57 | 0.05 | 1643 | 1644 |
| I904C | 904 | I | C | 0.57 | 0.22 | 1645 | 1646 |
| K595Q | 595 | K | Q | 0.57 | 0.06 | 1647 | 1648 |
| A406C | 406 | A | C | 0.57 | 0.29 | 1649 | 1650 |
| W362Y | 362 | W | Y | 0.57 | 0.92 | 1651 | 1652 |
| H909P | 909 | H | P | 0.57 | 0.61 | 1653 | 1654 |
| D625M | 625 | D | M | 0.57 | 0.06 | 1655 | 1656 |
| P1176N | 1176 | P | N | 0.56 | 0.05 | 1657 | 1658 |
| A1173K | 1173 | A | K | 0.56 | 0.05 | 1659 | 1660 |
| L66C | 66 | L | C | 0.56 | 1.02 | 1661 | 1662 |
| Q529G | 529 | Q | G | 0.56 | 0.07 | 1663 | 1664 |
| K1121F | 1121 | K | F | 0.56 | 0.12 | 1665 | 1666 |
| G532P | 532 | G | P | 0.56 | 0.07 | 1667 | 1668 |
| R182T | 182 | R | T | 0.56 | 0.13 | 1669 | 1670 |
| F490Q | 490 | F | Q | 0.56 | 1.04 | 1671 | 1672 |
| K1121G | 1121 | K | G | 0.56 | 0.1 | 1673 | 1674 |
| K614P | 614 | K | P | 0.56 | 0.64 | 1675 | 1676 |
| E858T | 858 | E | T | 0.56 | 0.93 | 1677 | 1678 |
| K811F | 811 | K | F | 0.56 | 0.05 | 1679 | 1680 |
| D505T | 505 | D | T | 0.56 | 0.07 | 1681 | 1682 |
| S1132V | 1132 | S | V | 0.56 | 0.84 | 1683 | 1684 |
| K522I | 522 | K | I | 0.56 | 0.31 | 1685 | 1686 |
| N309G | 309 | N | G | 0.56 | 0.06 | 1687 | 1688 |
| V1083T | 1083 | V | T | 0.56 | 2.08 | 1689 | 1690 |
| S780Q | 780 | S | Q | 0.56 | 0.08 | 1691 | 1692 |
| K427D | 427 | K | D | 0.56 | 0.05 | 1693 | 1694 |
| F474N | 474 | F | N | 0.56 | 0.06 | 1695 | 1696 |
| H1228C | 1228 | H | C | 0.56 | 0.05 | 1697 | 1698 |
| F289M | 289 | F | M | 0.56 | 1.16 | 1699 | 1700 |
| Y606L | 606 | Y | L | 0.55 | 0.06 | 1701 | 1702 |
| I111A | 1111 | I | A | 0.55 | 0.26 | 1703 | 1704 |
| K274R | 274 | K | R | 0.55 | 0.18 | 1705 | 1706 |
| T230H | 230 | T | H | 0.55 | 0.06 | 1707 | 1708 |
| E579F | 579 | E | F | 0.55 | 0.06 | 1709 | 1710 |
| T16G | 16 | T | G | 0.55 | 0.95 | 1711 | 1712 |
| K269G | 269 | K | G | 0.55 | 0.07 | 1713 | 1714 |
| G353K | 353 | G | K | 0.55 | 0.3 | 1715 | 1716 |
| I417H | 417 | I | H | 0.55 | 0.47 | 1717 | 1718 |
| Y781S | 781 | Y | S | 0.55 | 0.13 | 1719 | 1720 |
| I860N | 860 | I | N | 0.55 | 0.04 | 1721 | 1722 |
| R737D | 737 | R | D | 0.55 | 0.19 | 1723 | 1724 |
| K1015W | 1015 | K | W | 0.55 | 0.07 | 1725 | 1726 |
| K361Y | 361 | K | Y | 0.55 | 0.06 | 1727 | 1728 |
| N582R | 582 | N | R | 0.55 | 0.06 | 1729 | 1730 |
| F884R | 884 | F | R | 0.55 | 0.39 | 1731 | 1732 |
| L210T | 210 | L | T | 0.55 | 0.31 | 1733 | 1734 |
| K110F | 110 | K | F | 0.55 | 0.11 | 1735 | 1736 |
| K1121S | 1121 | K | S | 0.55 | 0.11 | 1737 | 1738 |
| K917V | 917 | K | V | 0.55 | 0.31 | 1739 | 1740 |
| 685Y | 685 | A | Y | 0.55 | 0.23 | 1741 | 1742 |
| A364C | 364 | A | C | 0.55 | 0.03 | 1743 | 1744 |
| M949Q | 949 | M | Q | 0.54 | 0.24 | 1745 | 1746 |
| D1207C | 1207 | D | C | 0.54 | 0.13 | 1747 | 1748 |
| I1111C | 1111 | I | C | 0.54 | 0.31 | 1749 | 1750 |
| K444Y | 444 | K | Y | 0.54 | 0.41 | 1751 | 1752 |
| M1128E | 1128 | M | E | 0.54 | 0.05 | 1753 | 1754 |
| L301Y | 301 | L | Y | 0.54 | 0.22 | 1755 | 1756 |
| N1081P | 1081 | N | P | 0.54 | 0.31 | 1757 | 1758 |
| Y549W | 549 | Y | W | 0.54 | 0.23 | 1759 | 1760 |
| V280M | 280 | V | M | 0.54 | 0.26 | 1761 | 1762 |
| G222L | 222 | G | L | 0.54 | 0.31 | 1763 | 1764 |
| S1119M | 1119 | S | M | 0.54 | 0.01 | 1765 | 1766 |
| A166T | 166 | A | T | 0.54 | 0.31 | 1767 | 1768 |
| A166K | 166 | A | K | 0.54 | 0.23 | 1769 | 1770 |
| T1019I | 1019 | T | I | 0.54 | 0.42 | 1771 | 1772 |
| K1121W | 1121 | K | W | 0.54 | 0.04 | 1773 | 1774 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| R747W | 747 | R | W | 0.54 | 0.54 | 1775 | 1776 |
| K787F | 787 | K | F | 0.54 | 0.83 | 1777 | 1778 |
| D122A | 122 | D | A | 0.54 | 0.03 | 1779 | 1780 |
| K361L | 361 | K | L | 0.54 | 0.68 | 1781 | 1782 |
| T181E | 181 | T | E | 0.54 | 0.05 | 1783 | 1784 |
| K269H | 269 | K | H | 0.53 | 0.12 | 1785 | 1786 |
| A966E | 966 | A | E | 0.53 | 0.12 | 1787 | 1788 |
| T27P | 27 | T | P | 0.53 | 0.04 | 1789 | 1790 |
| D1207G | 1207 | D | G | 0.53 | 0.07 | 1791 | 1792 |
| H502V | 502 | H | V | 0.53 | 0.48 | 1793 | 1794 |
| N306Q | 306 | N | Q | 0.53 | 0.04 | 1795 | 1796 |
| V757R | 757 | V | R | 0.53 | 0.15 | 1797 | 1798 |
| R482Y | 482 | R | Y | 0.53 | 0.05 | 1799 | 1800 |
| Y918M | 918 | Y | M | 0.53 | 0.16 | 1801 | 1802 |
| L1098M | 1098 | L | M | 0.53 | 0.01 | 1803 | 1804 |
| Y605M | 605 | Y | M | 0.53 | 0.05 | 1805 | 1806 |
| L914E | 914 | L | E | 0.53 | 0.03 | 1807 | 1808 |
| G475D | 475 | G | D | 0.53 | 0.08 | 1809 | 1810 |
| R747D | 747 | R | D | 0.53 | 0.04 | 1811 | 1812 |
| K591L | 591 | K | L | 0.53 | 0.36 | 1813 | 1814 |
| M722S | 722 | M | S | 0.53 | 0.18 | 1815 | 1816 |
| D133C | 133 | D | C | 0.53 | 0.12 | 1817 | 1818 |
| V758T | 758 | V | T | 0.53 | 0.19 | 1819 | 1820 |
| E285C | 285 | E | C | 0.53 | 0.41 | 1821 | 1822 |
| N933R | 933 | N | R | 0.52 | 0.39 | 1823 | 1824 |
| S763V | 763 | S | V | 0.52 | 0.11 | 1825 | 1826 |
| D1207N | 1207 | D | N | 0.52 | 0.15 | 1827 | 1828 |
| N590H | 590 | N | H | 0.52 | 0.24 | 1829 | 1830 |
| S394E | 394 | S | E | 0.52 | 0.03 | 1831 | 1832 |
| K272C | 272 | K | C | 0.52 | 0.03 | 1833 | 1834 |
| E683L | 683 | E | L | 0.52 | 0.11 | 1835 | 1836 |
| G341L | 341 | G | L | 0.52 | 0.28 | 1837 | 1838 |
| P271G | 271 | P | G | 0.52 | 0.11 | 1839 | 1840 |
| L1192C | 1192 | L | C | 0.52 | 0.01 | 1841 | 1842 |
| S1093I | 1093 | S | I | 0.52 | 0.18 | 1843 | 1844 |
| M722C | 722 | M | C | 0.52 | 0.32 | 1845 | 1846 |
| T1019N | 1019 | T | N | 0.52 | 0.13 | 1847 | 1848 |
| E885T | 885 | E | T | 0.52 | 0.27 | 1849 | 1850 |
| K415P | 415 | K | P | 0.52 | 0.32 | 1851 | 1852 |
| G475M | 475 | G | M | 0.52 | 0.06 | 1853 | 1854 |
| Y583T | 583 | Y | T | 0.52 | 0.43 | 1855 | 1856 |
| D729G | 729 | D | G | 0.52 | 0.54 | 1857 | 1858 |
| E1044A | 1044 | E | A | 0.52 | 0.09 | 1859 | 1860 |
| E221N | 221 | E | N | 0.52 | 0.44 | 1861 | 1862 |
| I850H | 850 | I | H | 0.51 | 0.1 | 1863 | 1864 |
| K568S | 568 | K | S | 0.51 | 0.23 | 1865 | 1866 |
| K269T | 269 | K | T | 0.51 | 0.17 | 1867 | 1868 |
| E1044T | 1044 | E | T | 0.51 | 0.38 | 1869 | 1870 |
| K269C | 269 | K | C | 0.51 | 0.03 | 1871 | 1872 |
| K514S | 514 | K | S | 0.51 | 0.03 | 1873 | 1874 |
| D1207A | 1207 | D | A | 0.51 | 0.02 | 1875 | 1876 |
| D559C | 559 | D | C | 0.51 | 0.43 | 1877 | 1878 |
| S14Q | 14 | S | Q | 0.51 | 0.05 | 1879 | 1880 |
| D792R | 792 | D | R | 0.51 | 0.04 | 1881 | 1882 |
| K387V | 387 | K | V | 0.51 | 0.07 | 1883 | 1884 |
| Y854G | 854 | Y | G | 0.51 | 0.12 | 1885 | 1886 |
| K499A | 499 | K | A | 0.51 | 0.14 | 1887 | 1888 |
| R482W | 482 | R | W | 0.51 | 0.15 | 1889 | 1890 |
| D919I | 919 | D | I | 0.51 | 0.83 | 1891 | 1892 |
| R1165Q | 1165 | R | Q | 0.5 | 0.27 | 1893 | 1894 |
| A1194W | 1194 | A | W | 0.5 | 0.93 | 1895 | 1896 |
| Y1066O | 1066 | Y | C | 0.5 | 0.15 | 1897 | 1898 |
| S763K | 763 | S | K | 0.5 | 0.02 | 1899 | 1900 |
| K1121T | 1121 | K | T | 0.5 | 0.14 | 1901 | 1902 |
| I859P | 859 | I | P | 0.5 | 0.94 | 1903 | 1904 |
| G576N | 576 | G | N | 0.5 | 0.43 | 1905 | 1906 |
| K72G | 72 | K | G | 0.5 | 0.14 | 1907 | 1908 |
| V228C | 228 | V | C | 0.5 | 0.22 | 1909 | 1910 |
| T1016F | 1016 | T | F | 0.5 | 0.15 | 1911 | 1912 |
| Y781R | 781 | Y | R | 0.5 | 0.1 | 1913 | 1914 |
| E285P | 285 | E | P | 0.5 | 0.03 | 1915 | 1916 |
| S1024F | 1024 | S | F | 0.5 | 0.12 | 1917 | 1918 |
| S1053V | 1053 | S | V | 0.5 | 0.15 | 1919 | 1920 |
| I22R | 22 | I | R | 0.5 | 0.53 | 1921 | 1922 |
| I184E | 184 | I | E | 0.5 | 0.36 | 1923 | 1924 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| N179L | 179 | N | L | 0.5 | 0.07 | 1925 | 1926 |
| S1024V | 1024 | S | V | 0.5 | 0.05 | 1927 | 1928 |
| E416Q | 416 | E | Q | 0.5 | 0.11 | 1929 | 1930 |
| R182M | 182 | R | M | 0.5 | 0.27 | 1931 | 1932 |
| R645T | 645 | R | T | 0.49 | 0.61 | 1933 | 1934 |
| R182A | 182 | R | A | 0.49 | 0.07 | 1935 | 1936 |
| E674L | 674 | E | L | 0.49 | 0.02 | 1937 | 1938 |
| D283I | 283 | D | I | 0.49 | 0.06 | 1939 | 1940 |
| S394T | 394 | S | T | 0.49 | 0 | 1941 | 1942 |
| N889T | 889 | N | T | 0.49 | 0.08 | 1943 | 1944 |
| K1155S | 1155 | K | S | 0.49 | 0.42 | 1945 | 1946 |
| S248E | 248 | S | E | 0.49 | 0.05 | 1947 | 1948 |
| A970G | 970 | A | G | 0.49 | 0.16 | 1949 | 1950 |
| K1015G | 1015 | K | G | 0.49 | 0.04 | 1951 | 1952 |
| F197R | 197 | F | R | 0.49 | 0.07 | 1953 | 1954 |
| K116Y | 116 | K | Y | 0.49 | 0.06 | 1955 | 1956 |
| E88P | 88 | E | P | 0.49 | 0.33 | 1957 | 1958 |
| E913R | 913 | E | R | 0.49 | 0.03 | 1959 | 1960 |
| V783I | 783 | V | I | 0.49 | 0.5 | 1961 | 1962 |
| A685F | 685 | A | F | 0.49 | 0.26 | 1963 | 1964 |
| V428Q | 428 | V | Q | 0.49 | 0.05 | 1965 | 1966 |
| D213K | 213 | D | K | 0.49 | 0.18 | 1967 | 1968 |
| E88R | 88 | E | R | 0.49 | 0.21 | 1969 | 1970 |
| G353V | 353 | G | V | 0.49 | 0.13 | 1971 | 1972 |
| D871C | 871 | D | C | 0.49 | 0.57 | 1973 | 1974 |
| E835Q | 835 | E | Q | 0.48 | 0.19 | 1975 | 1976 |
| L629N | 629 | L | N | 0.48 | 0.32 | 1977 | 1978 |
| K84A | 84 | K | A | 0.48 | 0.88 | 1979 | 1980 |
| T266Q | 266 | T | Q | 0.48 | 0.68 | 1981 | 1982 |
| F1045T | 1045 | F | T | 0.48 | 0.18 | 1983 | 1984 |
| K272S | 272 | K | S | 0.48 | 0.11 | 1985 | 1986 |
| N656W | 656 | N | W | 0.48 | 0.16 | 1987 | 1988 |
| I922L | 922 | I | L | 0.48 | 0.07 | 1989 | 1990 |
| K568A | 568 | K | A | 0.48 | 0.16 | 1991 | 1992 |
| K167M | 167 | K | M | 0.48 | 0.41 | 1993 | 1994 |
| A1022D | 1022 | A | D | 0.48 | 0.22 | 1995 | 1996 |
| F709N | 709 | F | N | 0.48 | 0.5 | 1997 | 1998 |
| Y854E | 854 | Y | E | 0.48 | 0.11 | 1999 | 2000 |
| R737M | 737 | R | M | 0.48 | 0.03 | 2001 | 2002 |
| F131N | 131 | F | N | 0.48 | 1.69 | 2003 | 2004 |
| I417L | 417 | I | L | 0.48 | 0.27 | 2005 | 2006 |
| K478H | 478 | K | H | 0.48 | 0.05 | 2007 | 2008 |
| V690R | 690 | V | R | 0.48 | 0.12 | 2009 | 2010 |
| K1025V | 1025 | K | V | 0.48 | 0.02 | 2011 | 2012 |
| E981R | 981 | E | R | 0.47 | 0.5 | 2013 | 2014 |
| S681F | 681 | S | F | 0.47 | 0.1 | 2015 | 2016 |
| K807L | 807 | K | L | 0.47 | 0.13 | 2017 | 2018 |
| K110V | 110 | K | V | 0.47 | 0.11 | 2019 | 2020 |
| E683V | 683 | E | V | 0.47 | 0.01 | 2021 | 2022 |
| T1142W | 1142 | T | W | 0.47 | 0.13 | 2023 | 2024 |
| S143C | 143 | S | C | 0.47 | 0.09 | 2025 | 2026 |
| K1050R | 1050 | K | R | 0.47 | 0.02 | 2027 | 2028 |
| D156R | 156 | D | R | 0.47 | 0.04 | 2029 | 2030 |
| K1015L | 1015 | K | L | 0.47 | 0.08 | 2031 | 2032 |
| E835R | 835 | E | R | 0.47 | 0.19 | 2033 | 2034 |
| N577G | 577 | N | G | 0.47 | 0.08 | 2035 | 2036 |
| T776I | 776 | T | I | 0.47 | 1.44 | 2037 | 2038 |
| T776R | 776 | T | R | 0.47 | 1.43 | 2039 | 2040 |
| I850M | 850 | I | M | 0.47 | 0.16 | 2041 | 2042 |
| R836Q | 836 | R | Q | 0.47 | 0.19 | 2043 | 2044 |
| S394M | 394 | S | M | 0.47 | 0.14 | 2045 | 2046 |
| E217W | 217 | E | W | 0.47 | 0.11 | 2047 | 2048 |
| V441P | 441 | V | P | 0.47 | 0.05 | 2049 | 2050 |
| K1121Q | 1121 | K | Q | 0.47 | 0.08 | 2051 | 2052 |
| D156P | 156 | D | P | 0.47 | 0.07 | 2053 | 2054 |
| G477E | 477 | G | E | 0.47 | 0.07 | 2055 | 2056 |
| E398K | 398 | E | K | 0.46 | 0.45 | 2057 | 2058 |
| N590M | 590 | N | M | 0.46 | 0.33 | 2059 | 2060 |
| K536M | 536 | K | M | 0.46 | 1.29 | 2061 | 2062 |
| P997K | 997 | P | K | 0.46 | 0.25 | 2063 | 2064 |
| Y781D | 781 | Y | D | 0.46 | 0 | 2065 | 2066 |
| F1127A | 1127 | F | A | 0.46 | 0.6 | 2067 | 2068 |
| K1096M | 1096 | K | M | 0.46 | 0.05 | 2069 | 2070 |
| S929K | 929 | S | K | 0.46 | 0.12 | 2071 | 2072 |
| K662C | 662 | K | C | 0.46 | 0.03 | 2073 | 2074 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| S1225A | 1225 | S | A | 0.46 | 0.01 | 2075 | 2076 |
| K937H | 937 | K | H | 0.46 | 0.31 | 2077 | 2078 |
| K1061F | 1061 | K | F | 0.46 | 0.07 | 2079 | 2080 |
| N630W | 630 | N | W | 0.46 | 0.11 | 2081 | 2082 |
| V816K | 816 | V | K | 0.46 | 0.1 | 2083 | 2084 |
| T1145H | 1145 | T | H | 0.46 | 0.82 | 2085 | 2086 |
| E412Y | 412 | E | Y | 0.46 | 0.07 | 2087 | 2088 |
| L585R | 585 | L | R | 0.46 | 0.21 | 2089 | 2090 |
| K520T | 520 | K | T | 0.46 | 0.08 | 2091 | 2092 |
| V491Q | 491 | V | Q | 0.46 | 0.14 | 2093 | 2094 |
| A1129C | 1129 | A | C | 0.46 | 0.15 | 2095 | 2096 |
| D1207P | 1207 | D | P | 0.46 | 0.03 | 2097 | 2098 |
| K269Q | 269 | K | Q | 0.46 | 0 | 2099 | 2100 |
| K984F | 984 | K | F | 0.46 | 0.28 | 2101 | 2102 |
| L839V | 839 | L | V | 0.46 | 0.1 | 2103 | 2104 |
| H759E | 759 | H | E | 0.46 | 0.73 | 2105 | 2106 |
| E885Y | 885 | E | Y | 0.46 | 0.29 | 2107 | 2108 |
| K1061A | 1061 | K | A | 0.46 | 0.09 | 2109 | 2110 |
| G973K | 973 | G | K | 0.45 | 0.24 | 2111 | 2112 |
| S1140F | 1140 | S | F | 0.45 | 0.08 | 2113 | 2114 |
| K272A | 272 | K | A | 0.45 | 0.02 | 2115 | 2116 |
| D1207R | 1207 | D | R | 0.45 | 0.11 | 2117 | 2118 |
| E125L | 125 | E | L | 0.45 | 0.09 | 2119 | 2120 |
| D283S | 283 | D | S | 0.45 | 0.02 | 2121 | 2122 |
| N481W | 481 | N | W | 0.45 | 0.21 | 2123 | 2124 |
| D1207M | 1207 | D | M | 0.45 | 0.07 | 2125 | 2126 |
| P799T | 799 | P | T | 0.45 | 0.07 | 2127 | 2128 |
| Y781G | 781 | Y | G | 0.45 | 0.05 | 2129 | 2130 |
| S763N | 763 | S | N | 0.45 | 0.03 | 2131 | 2132 |
| A1046Y | 1046 | A | Y | 0.45 | 0.34 | 2133 | 2134 |
| I860C | 860 | I | C | 0.45 | 0.54 | 2135 | 2136 |
| S445Q | 445 | S | Q | 0.45 | 0.05 | 2137 | 2138 |
| E95L | 95 | E | L | 0.45 | 0.16 | 2139 | 2140 |
| F597T | 597 | F | T | 0.45 | 0.99 | 2141 | 2142 |
| F224A | 224 | F | A | 0.45 | 0.34 | 2143 | 2144 |
| R867S | 867 | R | S | 0.45 | 0.6 | 2145 | 2146 |
| E1039S | 1039 | E | S | 0.45 | 0.15 | 2147 | 2148 |
| A749E | 749 | A | E | 0.45 | 0.73 | 2149 | 2150 |
| I765R | 765 | I | R | 0.45 | 0.26 | 2151 | 2152 |
| M746R | 746 | M | R | 0.45 | 0.34 | 2153 | 2154 |
| K1177L | 1177 | K | L | 0.44 | 0.1 | 2155 | 2156 |
| F197A | 197 | F | A | 0.44 | 0.07 | 2157 | 2158 |
| I425G | 425 | I | G | 0.44 | 0.73 | 2159 | 2160 |
| M1128D | 1128 | M | D | 0.44 | 0.06 | 2161 | 2162 |
| V216C | 216 | V | C | 0.44 | 0.05 | 2163 | 2164 |
| K614Y | 614 | K | Y | 0.44 | 0.26 | 2165 | 2166 |
| H200F | 200 | H | F | 0.44 | 0.16 | 2167 | 2168 |
| G991C | 991 | G | C | 0.44 | 0.72 | 2169 | 2170 |
| K413Y | 413 | K | Y | 0.44 | 0.05 | 2171 | 2172 |
| K269E | 269 | K | E | 0.44 | 0.04 | 2173 | 2174 |
| N311G | 311 | N | G | 0.44 | 0.84 | 2175 | 2176 |
| T307M | 307 | T | M | 0.44 | 0.84 | 2177 | 2178 |
| I138A | 138 | I | A | 0.44 | 0.15 | 2179 | 2180 |
| F728C | 728 | F | C | 0.44 | 0.72 | 2181 | 2182 |
| L779A | 779 | L | A | 0.44 | 0.01 | 2183 | 2184 |
| A493N | 493 | A | N | 0.44 | 0.06 | 2185 | 2186 |
| N327H | 327 | N | H | 0.44 | 0.26 | 2187 | 2188 |
| S644K | 644 | S | K | 0.44 | 0.12 | 2189 | 2190 |
| S212T | 212 | S | T | 0.44 | 0.83 | 2191 | 2192 |
| E313T | 313 | E | T | 0.44 | 1.14 | 2193 | 2194 |
| K272Y | 272 | K | Y | 0.44 | 0.02 | 2195 | 2196 |
| E330K | 330 | E | K | 0.44 | 0.1 | 2197 | 2198 |
| I138G | 138 | I | G | 0.44 | 0.83 | 2199 | 2200 |
| G1009H | 1009 | G | H | 0.44 | 0.72 | 2201 | 2202 |
| T1092G | 1092 | T | G | 0.44 | 0.03 | 2203 | 2204 |
| E852Q | 852 | E | Q | 0.44 | 0.42 | 2205 | 2206 |
| E1097Q | 1097 | E | Q | 0.43 | 0.83 | 2207 | 2208 |
| F810R | 810 | F | R | 0.43 | 0.45 | 2209 | 2210 |
| N861H | 861 | N | H | 0.43 | 0.73 | 2211 | 2212 |
| E913I | 913 | E | I | 0.43 | 0.08 | 2213 | 2214 |
| F109K | 109 | F | K | 0.43 | 0.73 | 2215 | 2216 |
| K89M | 89 | K | M | 0.43 | 0.05 | 2217 | 2218 |
| K1015Q | 1015 | K | Q | 0.43 | 0.02 | 2219 | 2220 |
| R102E | 102 | R | E | 0.43 | 0.83 | 2221 | 2222 |
| T1142A | 1142 | T | A | 0.43 | 0.13 | 2223 | 2224 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| S710W | 710 | S | W | 0.43 | 0.72 | 2225 | 2226 |
| D122R | 122 | D | R | 0.43 | 0.09 | 2227 | 2228 |
| K269V | 269 | K | V | 0.43 | 0.03 | 2229 | 2230 |
| D611Q | 611 | D | Q | 0.43 | 0.03 | 2231 | 2232 |
| S609F | 609 | S | F | 0.43 | 0.84 | 2233 | 2234 |
| T152G | 152 | T | G | 0.43 | 0.05 | 2235 | 2236 |
| Y605I | 605 | Y | I | 0.43 | 0.08 | 2237 | 2238 |
| I951Q | 951 | I | Q | 0.43 | 0.73 | 2239 | 2240 |
| M626P | 626 | M | P | 0.43 | 0.02 | 2241 | 2242 |
| N76L | 76 | N | L | 0.43 | 0.73 | 2243 | 2244 |
| F1010P | 1010 | F | P | 0.43 | 0.72 | 2245 | 2246 |
| D136L | 136 | D | L | 0.43 | 0.83 | 2247 | 2248 |
| S394K | 394 | S | K | 0.43 | 0.08 | 2249 | 2250 |
| N837V | 837 | N | V | 0.43 | 0.25 | 2251 | 2252 |
| K278C | 278 | K | C | 0.43 | 0.26 | 2253 | 2254 |
| N862C | 862 | N | C | 0.43 | 0.26 | 2255 | 2256 |
| A172E | 172 | A | E | 0.43 | 0.83 | 2257 | 2258 |
| G291K | 291 | G | K | 0.43 | 0.23 | 2259 | 2260 |
| F81N | 81 | F | N | 0.43 | 0.14 | 2261 | 2262 |
| I259G | 259 | I | G | 0.43 | 0.03 | 2263 | 2264 |
| A901K | 901 | A | K | 0.43 | 0.83 | 2265 | 2266 |
| V216A | 216 | V | A | 0.43 | 0 | 2267 | 2268 |
| A1201I | 1201 | A | I | 0.43 | 0.25 | 2269 | 2270 |
| F436R | 436 | F | R | 0.43 | 0.58 | 2271 | 2272 |
| F109C | 109 | F | C | 0.43 | 0.17 | 2273 | 2274 |
| A923E | 923 | A | E | 0.43 | 0.83 | 2275 | 2276 |
| N75P | 75 | N | P | 0.43 | 0.16 | 2277 | 2278 |
| I911G | 911 | I | G | 0.43 | 0.83 | 2279 | 2280 |
| G477S | 477 | G | S | 0.43 | 0.08 | 2281 | 2282 |
| D156Y | 156 | D | Y | 0.43 | 0.12 | 2283 | 2284 |
| K269W | 269 | K | W | 0.43 | 0.16 | 2285 | 2286 |
| Y956Q | 956 | Y | Q | 0.43 | 0.73 | 2287 | 2288 |
| V236H | 236 | V | H | 0.43 | 0.83 | 2289 | 2290 |
| L1115Y | 1115 | L | Y | 0.43 | 0.83 | 2291 | 2292 |
| V816H | 816 | V | H | 0.43 | 0.83 | 2293 | 2294 |
| K272F | 272 | K | F | 0.43 | 0.07 | 2295 | 2296 |
| D461W | 461 | D | W | 0.43 | 0.26 | 2297 | 2298 |
| N1186Y | 1186 | N | Y | 0.43 | 0.82 | 2299 | 2300 |
| K265H | 265 | K | H | 0.43 | 0.83 | 2301 | 2302 |
| K707H | 707 | K | H | 0.43 | 0.72 | 2303 | 2304 |
| G335T | 335 | G | T | 0.43 | 0.14 | 2305 | 2306 |
| L738K | 738 | L | K | 0.43 | 0.83 | 2307 | 2308 |
| D122G | 122 | D | G | 0.43 | 0.26 | 2309 | 2310 |
| I581V | 581 | I | V | 0.43 | 0.14 | 2311 | 2312 |
| K1121H | 1121 | K | H | 0.43 | 0.16 | 2313 | 2314 |
| I78S | 78 | I | S | 0.43 | 0.82 | 2315 | 2316 |
| I1021S | 1021 | I | S | 0.43 | 0.26 | 2317 | 2318 |
| Y705C | 705 | Y | C | 0.43 | 0.02 | 2319 | 2320 |
| F473R | 473 | F | R | 0.42 | 0.14 | 2321 | 2322 |
| A451E | 451 | A | E | 0.42 | 0.22 | 2323 | 2324 |
| L927K | 927 | L | K | 0.42 | 0.25 | 2325 | 2326 |
| V216H | 216 | V | H | 0.42 | 0.51 | 2327 | 2328 |
| S163I | 163 | S | I | 0.42 | 0.72 | 2329 | 2330 |
| S332L | 332 | S | L | 0.42 | 0.72 | 2331 | 2332 |
| Y1102N | 1102 | Y | N | 0.42 | 0.26 | 2333 | 2334 |
| M1035F | 1035 | M | F | 0.42 | 0.06 | 2335 | 2336 |
| I612E | 612 | I | E | 0.42 | 0.72 | 2337 | 2338 |
| A1184W | 1184 | A | W | 0.42 | 0.82 | 2339 | 2340 |
| E98W | 98 | E | W | 0.42 | 0.06 | 2341 | 2342 |
| D1041V | 1041 | D | V | 0.42 | 0.4 | 2343 | 2344 |
| S1024W | 1024 | S | W | 0.42 | 0.24 | 2345 | 2346 |
| I369H | 369 | I | H | 0.42 | 0.06 | 2347 | 2348 |
| N157P | 157 | N | P | 0.42 | 0.72 | 2349 | 2350 |
| K752H | 752 | K | H | 0.42 | 0.73 | 2351 | 2352 |
| A1057D | 1057 | A | D | 0.42 | 0.26 | 2353 | 2354 |
| I841C | 841 | I | C | 0.42 | 0.13 | 2355 | 2356 |
| R359K | 359 | R | K | 0.42 | 0.72 | 2357 | 2358 |
| K1017F | 1017 | K | F | 0.42 | 0.83 | 2359 | 2360 |
| F530R | 530 | F | R | 0.42 | 0.85 | 2361 | 2362 |
| T777P | 777 | T | P | 0.42 | 0.24 | 2363 | 2364 |
| G242I | 242 | G | I | 0.42 | 0.26 | 2365 | 2366 |
| N889M | 889 | N | M | 0.42 | 0.06 | 2367 | 2368 |
| K1121L | 1121 | K | L | 0.42 | 0 | 2369 | 2370 |
| K1015S | 1015 | K | S | 0.42 | 0.05 | 2371 | 2372 |
| I736H | 736 | I | H | 0.42 | 0.83 | 2373 | 2374 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| Y700G | 700 | Y | G | 0.42 | 0.72 | 2375 | 2376 |
| D665H | 665 | D | H | 0.42 | 0.04 | 2377 | 2378 |
| Q203D | 203 | Q | D | 0.42 | 0.17 | 2379 | 2380 |
| G477V | 477 | G | V | 0.42 | 0.08 | 2381 | 2382 |
| E479W | 479 | E | W | 0.42 | 0.07 | 2383 | 2384 |
| T246C | 246 | T | C | 0.42 | 0.15 | 2385 | 2386 |
| I470L | 470 | I | L | 0.42 | 0.26 | 2387 | 2388 |
| S282N | 282 | S | N | 0.42 | 0.72 | 2389 | 2390 |
| K391Y | 391 | K | Y | 0.42 | 0.26 | 2391 | 2392 |
| K897A | 897 | K | A | 0.42 | 0.02 | 2393 | 2394 |
| Y1221M | 1221 | Y | M | 0.42 | 0.02 | 2395 | 2396 |
| Y903P | 903 | Y | P | 0.42 | 0.83 | 2397 | 2398 |
| V828Y | 828 | V | Y | 0.42 | 0.72 | 2399 | 2400 |
| Y903G | 903 | Y | G | 0.42 | 0.72 | 2401 | 2402 |
| Y554M | 554 | Y | M | 0.42 | 0.14 | 2403 | 2404 |
| K1015C | 1015 | K | C | 0.42 | 0.13 | 2405 | 2406 |
| L497D | 497 | L | D | 0.42 | 0.71 | 2407 | 2408 |
| I860F | 860 | I | F | 0.42 | 0.05 | 2409 | 2410 |
| I569D | 569 | I | D | 0.42 | 0.27 | 2411 | 2412 |
| L101C | 101 | L | C | 0.42 | 0.18 | 2413 | 2414 |
| F227H | 227 | F | H | 0.42 | 0.83 | 2415 | 2416 |
| I234D | 234 | I | D | 0.42 | 0.83 | 2417 | 2418 |
| F1027M | 1027 | F | M | 0.42 | 0.19 | 2419 | 2420 |
| K107M | 107 | K | M | 0.41 | 0.08 | 2421 | 2422 |
| Y781W | 781 | Y | W | 0.41 | 0.18 | 2423 | 2424 |
| E98M | 98 | E | M | 0.41 | 0.96 | 2425 | 2426 |
| D384T | 384 | D | T | 0.41 | 0.03 | 2427 | 2428 |
| L693D | 693 | L | D | 0.41 | 0.48 | 2429 | 2430 |
| K349G | 349 | K | G | 0.41 | 0.26 | 2431 | 2432 |
| L281Y | 281 | L | Y | 0.41 | 0.36 | 2433 | 2434 |
| D572W | 572 | D | W | 0.41 | 0.12 | 2435 | 2436 |
| L566H | 566 | L | H | 0.41 | 0.84 | 2437 | 2438 |
| E913K | 913 | E | K | 0.41 | 0.02 | 2439 | 2440 |
| I557V | 557 | I | V | 0.41 | 0.27 | 2441 | 2442 |
| N731E | 731 | N | E | 0.41 | 0.17 | 2443 | 2444 |
| T716Q | 716 | T | Q | 0.41 | 1.78 | 2445 | 2446 |
| I831L | 831 | I | L | 0.41 | 0.1 | 2447 | 2448 |
| Y1018E | 1018 | Y | E | 0.41 | 0 | 2449 | 2450 |
| L1065R | 1065 | L | R | 0.41 | 0.16 | 2451 | 2452 |
| I419R | 419 | I | R | 0.41 | 0.09 | 2453 | 2454 |
| I314Q | 314 | I | Q | 0.41 | 0.14 | 2455 | 2456 |
| M1134R | 1134 | M | R | 0.41 | 0.02 | 2457 | 2458 |
| A1188L | 1188 | A | L | 0.41 | 0.79 | 2459 | 2460 |
| S168V | 168 | S | V | 0.41 | 0.14 | 2461 | 2462 |
| P799R | 799 | P | R | 0.41 | 0.03 | 2463 | 2464 |
| C805L | 805 | C | L | 0.41 | 0.17 | 2465 | 2466 |
| T16A | 16 | T | A | 0.41 | 0.74 | 2467 | 2468 |
| D782Q | 782 | D | Q | 0.41 | 0.08 | 2469 | 2470 |
| D122M | 122 | D | M | 0.41 | 0.25 | 2471 | 2472 |
| Y1162A | 1162 | Y | A | 0.41 | 0.73 | 2473 | 2474 |
| S143G | 143 | S | G | 0.41 | 0.05 | 2475 | 2476 |
| S1020L | 1020 | S | L | 0.41 | 0.01 | 2477 | 2478 |
| K1205P | 1205 | K | P | 0.41 | 0.46 | 2479 | 2480 |
| G254D | 254 | G | D | 0.4 | 0.43 | 2481 | 2482 |
| R182G | 182 | R | G | 0.4 | 0 | 2483 | 2484 |
| R1112W | 1112 | R | W | 0.4 | 0.31 | 2485 | 2486 |
| T480I | 480 | T | I | 0.4 | 0.35 | 2487 | 2488 |
| L492H | 492 | L | H | 0.4 | 0.06 | 2489 | 2490 |
| K52P | 52 | K | P | 0.4 | 0.74 | 2491 | 2492 |
| L744M | 744 | L | M | 0.4 | 0.17 | 2493 | 2494 |
| L210N | 210 | L | N | 0.4 | 0.07 | 2495 | 2496 |
| I1072S | 1072 | I | S | 0.4 | 0.21 | 2497 | 2498 |
| G734Q | 734 | G | Q | 0.4 | 0.05 | 2499 | 2500 |
| I205C | 205 | I | C | 0.4 | 0.07 | 2501 | 2502 |
| Y115P | 115 | Y | P | 0.4 | 0.29 | 2503 | 2504 |
| T1224D | 1224 | T | D | 0.4 | 0.69 | 2505 | 2506 |
| L699D | 699 | L | D | 0.4 | 0.09 | 2507 | 2508 |
| G1196E | 1196 | G | E | 0.4 | 0.11 | 2509 | 2510 |
| K3M | 3 | K | M | 0.4 | 0.75 | 2511 | 2512 |
| K272V | 272 | K | V | 0.4 | 0.09 | 2513 | 2514 |
| L876A | 876 | L | A | 0.4 | 0.1 | 2515 | 2516 |
| R482H | 482 | R | H | 0.4 | 0.11 | 2517 | 2518 |
| Y678E | 678 | Y | E | 0.4 | 0.72 | 2519 | 2520 |
| E292M | 292 | E | M | 0.4 | 0.03 | 2521 | 2522 |
| Y77W | 77 | Y | W | 0.4 | 0.25 | 2523 | 2524 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| S1024G | 1024 | S | G | 0.4 | 0.04 | 2525 | 2526 |
| E95A | 95 | E | A | 0.4 | 0.02 | 2527 | 2528 |
| E981F | 981 | E | F | 0.4 | 0.11 | 2529 | 2530 |
| A1173N | 1173 | A | N | 0.4 | 0.13 | 2531 | 2532 |
| D495E | 495 | D | E | 0.4 | 0.08 | 2533 | 2534 |
| K272P | 272 | K | P | 0.4 | 0.14 | 2535 | 2536 |
| A404R | 404 | A | R | 0.4 | 0.21 | 2537 | 2538 |
| V921G | 921 | V | G | 0.4 | 0.04 | 2539 | 2540 |
| Y1221K | 1221 | Y | K | 0.4 | 0.12 | 2541 | 2542 |
| K373F | 373 | K | F | 0.4 | 0.2 | 2543 | 2544 |
| F728S | 728 | F | S | 0.4 | 0.45 | 2545 | 2546 |
| I418K | 418 | I | K | 0.4 | 0.02 | 2547 | 2548 |
| E1217F | 1217 | E | F | 0.4 | 0.83 | 2549 | 2550 |
| F224G | 224 | F | G | 0.4 | 0.23 | 2551 | 2552 |
| S143M | 143 | S | M | 0.4 | 0.05 | 2553 | 2554 |
| D156G | 156 | D | G | 0.4 | 0 | 2555 | 2556 |
| A1022E | 1022 | A | E | 0.4 | 0.17 | 2557 | 2558 |
| N481F | 481 | N | F | 0.4 | 0.13 | 2559 | 2560 |
| I69P | 69 | I | P | 0.4 | 0.09 | 2561 | 2562 |
| K361V | 361 | K | V | 0.4 | 0.06 | 2563 | 2564 |
| T776E | 776 | T | E | 0.4 | 1.72 | 2565 | 2566 |
| K1064 | 1064 | K | M | 0.39 | 0.59 | 2567 | 2568 |
| G475K | 475 | G | K | 0.39 | 0.11 | 2569 | 2570 |
| K1026P | 1026 | K | P | 0.39 | 0.11 | 2571 | 2572 |
| S409D | 409 | S | D | 0.39 | 0.21 | 2573 | 2574 |
| N577A | 577 | N | A | 0.39 | 0.18 | 2575 | 2576 |
| Y646S | 646 | Y | S | 0.39 | 0.21 | 2577 | 2578 |
| I951L | 951 | I | L | 0.39 | 0.14 | 2579 | 2580 |
| D1163C | 1163 | D | C | 0.39 | 0.11 | 2581 | 2582 |
| G114Q | 114 | G | Q | 0.39 | 0.24 | 2583 | 2584 |
| N862L | 862 | N | L | 0.39 | 0.25 | 2585 | 2586 |
| N656I | 656 | N | I | 0.39 | 0.37 | 2587 | 2588 |
| K1177E | 1177 | K | E | 0.39 | 0.22 | 2589 | 2590 |
| L94D | 94 | L | D | 0.39 | 0.08 | 2591 | 2592 |
| S2H | 2 | S | H | 0.39 | 0.75 | 2593 | 2594 |
| K478E | 478 | K | E | 0.39 | 0.11 | 2595 | 2596 |
| L324E | 324 | L | E | 0.39 | 0.06 | 2597 | 2598 |
| L779V | 779 | L | V | 0.39 | 0.25 | 2599 | 2600 |
| I419Q | 419 | I | Q | 0.39 | 0.02 | 2601 | 2602 |
| A563G | 563 | A | G | 0.39 | 0.13 | 2603 | 2604 |
| T1019W | 1019 | T | W | 0.39 | 0.03 | 2605 | 2606 |
| F1052I | 1052 | F | I | 0.39 | 0.14 | 2607 | 2608 |
| K932F | 932 | K | F | 0.39 | 0.05 | 2609 | 2610 |
| K910I | 910 | K | I | 0.39 | 0.05 | 2611 | 2612 |
| Q567P | 567 | Q | P | 0.39 | 0.04 | 2613 | 2614 |
| V38D | 38 | V | D | 0.39 | 0.09 | 2615 | 2616 |
| A801D | 801 | A | D | 0.39 | 0.05 | 2617 | 2618 |
| G49I | 49 | G | I | 0.39 | 0.04 | 2619 | 2620 |
| V411D | 411 | V | D | 0.39 | 0.02 | 2621 | 2622 |
| F440E | 440 | F | E | 0.39 | 0.05 | 2623 | 2624 |
| Y827R | 827 | Y | R | 0.38 | 0.14 | 2625 | 2626 |
| E443Y | 443 | E | Y | 0.38 | 0.34 | 2627 | 2628 |
| Y57M | 57 | Y | M | 0.38 | 0.03 | 2629 | 2630 |
| Y700V | 700 | Y | V | 0.38 | 0.09 | 2631 | 2632 |
| N468E | 468 | N | E | 0.38 | 0.2 | 2633 | 2634 |
| M187R | 187 | M | R | 0.38 | 0.03 | 2635 | 2636 |
| G968P | 968 | G | P | 0.38 | 0.34 | 2637 | 2638 |
| M603S | 603 | M | S | 0.38 | 0.01 | 2639 | 2640 |
| N311E | 311 | N | E | 0.38 | 0.09 | 2641 | 2642 |
| N91G | 91 | N | G | 0.38 | 0.48 | 2643 | 2644 |
| K274Q | 274 | K | Q | 0.38 | 0.07 | 2645 | 2646 |
| T181D | 181 | T | D | 0.38 | 0.12 | 2647 | 2648 |
| R305V | 305 | R | V | 0.38 | 0.05 | 2649 | 2650 |
| E1204R | 1204 | E | R | 0.38 | 0.17 | 2651 | 2652 |
| K448C | 448 | K | C | 0.38 | 0.01 | 2653 | 2654 |
| L446W | 446 | L | W | 0.38 | 0.09 | 2655 | 2656 |
| A1122K | 1122 | A | K | 0.38 | 0.16 | 2657 | 2658 |
| R35N | 35 | R | N | 0.38 | 0.74 | 2659 | 2660 |
| L727I | 727 | L | I | 0.38 | 0.34 | 2661 | 2662 |
| I196W | 196 | I | W | 0.38 | 0.31 | 2663 | 2664 |
| N732I | 732 | N | I | 0.38 | 0.75 | 2665 | 2666 |
| Y58S | 58 | Y | S | 0.38 | 0.08 | 2667 | 2668 |
| I78V | 78 | I | V | 0.38 | 0.32 | 2669 | 2670 |
| K413V | 413 | K | V | 0.38 | 0.21 | 2671 | 2672 |
| K26V | 26 | K | V | 0.38 | 0.74 | 2673 | 2674 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| K878T | 878 | K | T | 0.38 | 0.04 | 2675 | 2676 |
| E913L | 913 | E | L | 0.37 | 0.06 | 2677 | 2678 |
| A667R | 667 | A | R | 0.37 | 0.18 | 2679 | 2680 |
| N857S | 857 | N | S | 0.37 | 0.34 | 2681 | 2682 |
| S763T | 763 | S | T | 0.37 | 0.04 | 2683 | 2684 |
| K1017A | 1017 | K | A | 0.37 | 0.08 | 2685 | 2686 |
| F530G | 530 | F | G | 0.37 | 0.56 | 2687 | 2688 |
| V491E | 491 | V | E | 0.37 | 0.05 | 2689 | 2690 |
| G846W | 846 | G | W | 0.37 | 0 | 2691 | 2692 |
| K1210L | 1210 | K | L | 0.37 | 0.82 | 2693 | 2694 |
| D665R | 665 | D | R | 0.37 | 0.06 | 2695 | 2696 |
| I1072Y | 1072 | I | Y | 0.37 | 0.33 | 2697 | 2698 |
| S296V | 296 | S | V | 0.37 | 0.01 | 2699 | 2700 |
| N955L | 955 | N | L | 0.37 | 0.06 | 2701 | 2702 |
| I911Q | 911 | I | Q | 0.37 | 0.64 | 2703 | 2704 |
| I189E | 189 | I | E | 0.37 | 0.17 | 2705 | 2706 |
| D156V | 156 | D | V | 0.37 | 0.05 | 2707 | 2708 |
| T1016E | 1016 | T | E | 0.37 | 0.18 | 2709 | 2710 |
| Y646R | 646 | Y | R | 0.37 | 0.61 | 2711 | 2712 |
| N179A | 179 | N | A | 0.37 | 0.36 | 2713 | 2714 |
| F436M | 436 | F | M | 0.37 | 0.03 | 2715 | 2716 |
| T814A | 814 | T | A | 0.37 | 0.16 | 2717 | 2718 |
| V783R | 783 | V | R | 0.37 | 0.08 | 2719 | 2720 |
| E285T | 285 | E | T | 0.37 | 0.24 | 2721 | 2722 |
| E791T | 791 | E | T | 0.37 | 0.05 | 2723 | 2724 |
| G848R | 848 | G | R | 0.37 | 0.08 | 2725 | 2726 |
| T891Y | 891 | T | Y | 0.37 | 0.04 | 2727 | 2728 |
| E479L | 479 | E | L | 0.37 | 0.11 | 2729 | 2730 |
| D877T | 877 | D | T | 0.37 | 0.73 | 2731 | 2732 |
| Q975Y | 975 | Q | Y | 0.36 | 0.13 | 2733 | 2734 |
| T152R | 152 | T | R | 0.36 | 0.04 | 2735 | 2736 |
| Y294K | 294 | Y | K | 0.36 | 0.34 | 2737 | 2738 |
| E88I | 88 | E | I | 0.36 | 0 | 2739 | 2740 |
| V24M | 24 | V | M | 0.36 | 0.29 | 2741 | 2742 |
| P589V | 589 | P | V | 0.36 | 0.1 | 2743 | 2744 |
| A685N | 685 | A | N | 0.36 | 0.35 | 2745 | 2746 |
| S710K | 710 | S | K | 0.36 | 0.31 | 2747 | 2748 |
| K421I | 421 | K | I | 0.36 | 0.26 | 2749 | 2750 |
| N582W | 582 | N | W | 0.36 | 0.2 | 2751 | 2752 |
| D1005S | 1005 | D | S | 0.36 | 1.11 | 2753 | 2754 |
| M1131P | 1131 | M | P | 0.36 | 0.28 | 2755 | 2756 |
| K1025F | 1025 | K | F | 0.36 | 0.05 | 2757 | 2758 |
| Y872D | 872 | Y | D | 0.36 | 0.02 | 2759 | 2760 |
| K940R | 940 | K | R | 0.36 | 0.48 | 2761 | 2762 |
| E913G | 913 | E | G | 0.36 | 0.11 | 2763 | 2764 |
| S143R | 143 | S | R | 0.36 | 0.08 | 2765 | 2766 |
| M558Y | 558 | M | Y | 0.36 | 0.1 | 2767 | 2768 |
| N889D | 889 | N | D | 0.36 | 0.04 | 2769 | 2770 |
| D1056E | 1056 | D | E | 0.36 | 0.15 | 2771 | 2772 |
| V422Y | 422 | V | Y | 0.36 | 0.28 | 2773 | 2774 |
| A1046H | 1046 | A | H | 0.36 | 0.62 | 2775 | 2776 |
| V441N | 441 | V | N | 0.36 | 0.02 | 2777 | 2778 |
| I636L | 636 | I | L | 0.36 | 1.32 | 2779 | 2780 |
| R887A | 887 | R | A | 0.36 | 0.04 | 2781 | 2782 |
| E88T | 88 | E | T | 0.36 | 0.12 | 2783 | 2784 |
| F1123Q | 1123 | F | Q | 0.36 | 0.38 | 2785 | 2786 |
| I22A | 22 | I | A | 0.36 | 0.2 | 2787 | 2788 |
| I557S | 557 | I | S | 0.36 | 0.08 | 2789 | 2790 |
| G740E | 740 | G | E | 0.36 | 0.64 | 2791 | 2792 |
| H733Q | 733 | H | Q | 0.36 | 0.08 | 2793 | 2794 |
| G624L | 624 | G | L | 0.36 | 0.22 | 2795 | 2796 |
| E104K | 104 | E | K | 0.36 | 0.12 | 2797 | 2798 |
| I829S | 829 | I | S | 0.36 | 0.23 | 2799 | 2800 |
| F669C | 669 | F | C | 0.36 | 0.07 | 2801 | 2802 |
| W890V | 890 | W | V | 0.36 | 0.04 | 2803 | 2804 |
| L13I | 13 | L | I | 0.36 | 0.12 | 2805 | 2806 |
| K937F | 937 | K | F | 0.36 | 0 | 2807 | 2808 |
| A761P | 761 | A | P | 0.36 | 0.13 | 2809 | 2810 |
| K1015E | 1015 | K | E | 0.36 | 0.09 | 2811 | 2812 |
| K499Y | 499 | K | Y | 0.36 | 0.22 | 2813 | 2814 |
| Y903D | 903 | Y | D | 0.36 | 0.11 | 2815 | 2816 |
| A1181G | 1181 | A | G | 0.36 | 0.01 | 2817 | 2818 |
| Y606M | 606 | Y | M | 0.36 | 0.09 | 2819 | 2820 |
| N145S | 145 | N | S | 0.36 | 0.02 | 2821 | 2822 |
| V38Q | 38 | V | Q | 0.36 | 0 | 2823 | 2824 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| Y705V | 705 | Y | V | 0.36 | 0.01 | 2825 | 2826 |
| S987M | 987 | S | M | 0.35 | 0.31 | 2827 | 2828 |
| A1046V | 1046 | A | V | 0.35 | 0.26 | 2829 | 2830 |
| E913M | 913 | E | M | 0.35 | 0.02 | 2831 | 2832 |
| D156N | 156 | D | N | 0.35 | 0.09 | 2833 | 2834 |
| K1015P | 1015 | K | P | 0.35 | 0.05 | 2835 | 2836 |
| S985Q | 985 | S | Q | 0.35 | 0.08 | 2837 | 2838 |
| F884V | 884 | F | V | 0.35 | 0.16 | 2839 | 2840 |
| E292V | 292 | E | V | 0.35 | 0.05 | 2841 | 2842 |
| N1070L | 1070 | N | L | 0.35 | 0.76 | 2843 | 2844 |
| S658F | 658 | S | F | 0.35 | 0.34 | 2845 | 2846 |
| A920M | 920 | A | M | 0.35 | 0.1 | 2847 | 2848 |
| S317F | 317 | S | F | 0.35 | 0.11 | 2849 | 2850 |
| Y974V | 974 | Y | V | 0.35 | 0.1 | 2851 | 2852 |
| Y487W | 487 | Y | W | 0.35 | 0.02 | 2853 | 2854 |
| Y918L | 918 | Y | L | 0.35 | 0.31 | 2855 | 2856 |
| I418N | 418 | I | N | 0.35 | 0.7 | 2857 | 2858 |
| K72V | 72 | K | V | 0.35 | 0.1 | 2859 | 2860 |
| D350M | 350 | D | M | 0.35 | 0.06 | 2861 | 2862 |
| D188C | 188 | D | C | 0.35 | 0.01 | 2863 | 2864 |
| V236C | 236 | V | C | 0.35 | 0.05 | 2865 | 2866 |
| N509L | 509 | N | L | 0.35 | 0.02 | 2867 | 2868 |
| Q613T | 613 | Q | T | 0.35 | 0.13 | 2869 | 2870 |
| Q279D | 279 | Q | D | 0.35 | 0.44 | 2871 | 2872 |
| S1140W | 1140 | S | W | 0.35 | 0.13 | 2873 | 2874 |
| K272M | 272 | K | M | 0.35 | 0.06 | 2875 | 2876 |
| G848T | 848 | G | T | 0.35 | 0.49 | 2877 | 2878 |
| E90K | 90 | E | K | 0.35 | 0.08 | 2879 | 2880 |
| N1082T | 1082 | N | T | 0.35 | 0.09 | 2881 | 2882 |
| E88W | 88 | E | W | 0.35 | 0 | 2883 | 2884 |
| N481V | 481 | N | V | 0.35 | 0.02 | 2885 | 2886 |
| D329E | 329 | D | E | 0.35 | 0.06 | 2887 | 2888 |
| I318Q | 318 | I | Q | 0.35 | 0.13 | 2889 | 2890 |
| L94K | 94 | L | K | 0.35 | 0.38 | 2891 | 2892 |
| Y469K | 469 | Y | K | 0.35 | 0.06 | 2893 | 2894 |
| N706Y | 706 | N | Y | 0.35 | 0.01 | 2895 | 2896 |
| F992G | 992 | F | G | 0.35 | 0.13 | 2897 | 2898 |
| M592R | 592 | M | R | 0.35 | 0.03 | 2899 | 2900 |
| N145R | 145 | N | R | 0.35 | 0.01 | 2901 | 2902 |
| A685R | 685 | A | R | 0.35 | 0.45 | 2903 | 2904 |
| V1089H | 1089 | V | H | 0.35 | 0.06 | 2905 | 2906 |
| D823A | 823 | D | A | 0.35 | 0.05 | 2907 | 2908 |
| Y827P | 827 | Y | P | 0.35 | 0.64 | 2909 | 2910 |
| N718R | 718 | N | R | 0.35 | 0.2 | 2911 | 2912 |
| V783Q | 783 | V | Q | 0.35 | 0.04 | 2913 | 2914 |
| K698D | 698 | K | D | 0.35 | 0.02 | 2915 | 2916 |
| Y1018D | 1018 | Y | D | 0.34 | 0.05 | 2917 | 2918 |
| K415E | 415 | K | E | 0.34 | 0.7 | 2919 | 2920 |
| K1015V | 1015 | K | V | 0.34 | 0.06 | 2921 | 2922 |
| V303Y | 303 | V | Y | 0.34 | 0.59 | 2923 | 2924 |
| D405F | 405 | D | F | 0.34 | 0.38 | 2925 | 2926 |
| K267V | 267 | K | V | 0.34 | 0.12 | 2927 | 2928 |
| Y469C | 469 | Y | C | 0.34 | 0.29 | 2929 | 2930 |
| N732M | 732 | N | M | 0.34 | 0.39 | 2931 | 2932 |
| Y670L | 670 | Y | L | 0.34 | 0.13 | 2933 | 2934 |
| H909C | 909 | H | C | 0.34 | 0.13 | 2935 | 2936 |
| W1086I | 1086 | W | I | 0.34 | 0.05 | 2937 | 2938 |
| K107A | 107 | K | A | 0.34 | 0.06 | 2939 | 2940 |
| F197N | 197 | F | N | 0.34 | 0.03 | 2941 | 2942 |
| E178R | 178 | E | R | 0.34 | 0.05 | 2943 | 2944 |
| P964N | 964 | P | N | 0.34 | 0.27 | 2945 | 2946 |
| W355E | 355 | W | E | 0.34 | 0.04 | 2947 | 2948 |
| F219H | 219 | F | H | 0.34 | 0.13 | 2949 | 2950 |
| K274S | 274 | K | S | 0.34 | 0.05 | 2951 | 2952 |
| R1033D | 1033 | R | D | 0.34 | 0.12 | 2953 | 2954 |
| Q613M | 613 | Q | M | 0.34 | 0.7 | 2955 | 2956 |
| E201Y | 201 | E | Y | 0.34 | 0.02 | 2957 | 2958 |
| R482V | 482 | R | V | 0.34 | 0.1 | 2959 | 2960 |
| D729W | 729 | D | W | 0.34 | 0.59 | 2961 | 2962 |
| E285L | 285 | E | L | 0.34 | 0.47 | 2963 | 2964 |
| F810C | 810 | F | C | 0.34 | 0.13 | 2965 | 2966 |
| S14I | 14 | S | I | 0.34 | 0 | 2967 | 2968 |
| K807N | 807 | K | N | 0.34 | 0.29 | 2969 | 2970 |
| S333M | 333 | S | M | 0.34 | 0.19 | 2971 | 2972 |
| K272L | 272 | K | L | 0.34 | 0.05 | 2973 | 2974 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| Y974D | 974 | Y | D | 0.34 | 0.14 | 2975 | 2976 |
| H909Q | 909 | H | Q | 0.34 | 0.05 | 2977 | 2978 |
| S485P | 485 | S | P | 0.34 | 0.01 | 2979 | 2980 |
| E913P | 913 | E | P | 0.34 | 0.7 | 2981 | 2982 |
| D1207I | 1207 | D | I | 0.34 | 0.21 | 2983 | 2984 |
| M1035N | 1035 | M | N | 0.34 | 0.38 | 2985 | 2986 |
| Q613C | 613 | Q | C | 0.34 | 0.01 | 2987 | 2988 |
| F490A | 490 | F | A | 0.34 | 0.02 | 2989 | 2990 |
| G114M | 114 | G | M | 0.34 | 0.09 | 2991 | 2992 |
| I841P | 841 | I | P | 0.34 | 0.01 | 2993 | 2994 |
| E39Y | 39 | E | Y | 0.34 | 0.14 | 2995 | 2996 |
| F655M | 655 | F | M | 0.34 | 0.27 | 2997 | 2998 |
| N263S | 263 | N | S | 0.34 | 0.15 | 2999 | 3000 |
| K945I | 945 | K | I | 0.34 | 0.39 | 3001 | 3002 |
| E247V | 247 | E | V | 0.34 | 0.15 | 3003 | 3004 |
| R82Q | 82 | R | Q | 0.34 | 0.04 | 3005 | 3006 |
| K253A | 253 | K | A | 0.34 | 0.59 | 3007 | 3008 |
| Y290A | 290 | Y | A | 0.34 | 0.05 | 3009 | 3010 |
| L1115N | 1115 | L | N | 0.34 | 0.59 | 3011 | 3012 |
| D501K | 501 | D | K | 0.34 | 0.58 | 3013 | 3014 |
| S79P | 79 | S | P | 0.34 | 0.21 | 3015 | 3016 |
| E815P | 815 | E | P | 0.34 | 0.26 | 3017 | 3018 |
| R482N | 482 | R | N | 0.34 | 0.59 | 3019 | 3020 |
| F162C | 162 | F | C | 0.33 | 0.6 | 3021 | 3022 |
| L1047N | 1047 | L | N | 0.33 | 0.02 | 3023 | 3024 |
| F597I | 597 | F | I | 0.33 | 0.07 | 3025 | 3026 |
| I841S | 841 | I | S | 0.33 | 0.14 | 3027 | 3028 |
| N732R | 732 | N | R | 0.33 | 0.18 | 3029 | 3030 |
| K1015T | 1015 | K | T | 0.33 | 0.05 | 3031 | 3032 |
| K413D | 413 | K | D | 0.33 | 0.15 | 3033 | 3034 |
| V376Y | 376 | V | Y | 0.33 | 0.17 | 3035 | 3036 |
| N656E | 656 | N | E | 0.33 | 0.25 | 3037 | 3038 |
| V303S | 303 | V | S | 0.33 | 0.22 | 3039 | 3040 |
| S982V | 982 | S | V | 0.33 | 0.41 | 3041 | 3042 |
| K1017L | 1017 | K | L | 0.33 | 0 | 3043 | 3044 |
| K83R | 83 | K | R | 0.33 | 0.02 | 3045 | 3046 |
| K1101Y | 1101 | K | Y | 0.33 | 0.5 | 3047 | 3048 |
| I209T | 209 | I | T | 0.33 | 0.57 | 3049 | 3050 |
| G973M | 973 | G | M | 0.33 | 0.25 | 3051 | 3052 |
| E247L | 247 | E | L | 0.33 | 0.38 | 3053 | 3054 |
| T776F | 776 | T | F | 0.33 | 0.13 | 3055 | 3056 |
| N861S | 861 | N | S | 0.33 | 0.47 | 3057 | 3058 |
| L492N | 492 | L | N | 0.33 | 0.11 | 3059 | 3060 |
| K448A | 448 | K | A | 0.33 | 0.18 | 3061 | 3062 |
| E90W | 90 | E | W | 0.33 | 0.18 | 3063 | 3064 |
| E98T | 98 | E | T | 0.33 | 0.18 | 3065 | 3066 |
| T988K | 988 | T | K | 0.33 | 0.06 | 3067 | 3068 |
| K499R | 499 | K | R | 0.33 | 0.11 | 3069 | 3070 |
| E743K | 743 | E | K | 0.33 | 0.23 | 3071 | 3072 |
| I503S | 503 | I | S | 0.33 | 0.02 | 3073 | 3074 |
| H714R | 714 | H | R | 0.33 | 0.02 | 3075 | 3076 |
| Y1018S | 1018 | Y | S | 0.33 | 0.19 | 3077 | 3078 |
| L261A | 261 | L | A | 0.33 | 0.7 | 3079 | 3080 |
| T776W | 776 | T | W | 0.33 | 0.26 | 3081 | 3082 |
| Y1068P | 1068 | Y | P | 0.33 | 0.59 | 3083 | 3084 |
| P342H | 342 | P | H | 0.33 | 0.18 | 3085 | 3086 |
| S780W | 780 | S | W | 0.33 | 0.13 | 3087 | 3088 |
| F1099K | 1099 | F | K | 0.33 | 0.6 | 3089 | 3090 |
| V758Y | 758 | V | Y | 0.33 | 0.11 | 3091 | 3092 |
| V280C | 280 | V | C | 0.33 | 0.1 | 3093 | 3094 |
| F1198R | 1198 | F | R | 0.33 | 0.6 | 3095 | 3096 |
| D489E | 489 | D | E | 0.33 | 0.21 | 3097 | 3098 |
| A334F | 334 | A | F | 0.33 | 0.41 | 3099 | 3100 |
| A970C | 970 | A | C | 0.33 | 0.02 | 3101 | 3102 |
| D1180T | 1180 | D | T | 0.33 | 0.69 | 3103 | 3104 |
| K1017E | 1017 | K | E | 0.33 | 0.28 | 3105 | 3106 |
| N718H | 718 | N | H | 0.33 | 0.15 | 3107 | 3108 |
| L914Y | 914 | L | Y | 0.32 | 0.08 | 3109 | 3110 |
| I557Y | 557 | I | Y | 0.32 | 0.5 | 3111 | 3112 |
| M592T | 592 | M | T | 0.32 | 0.29 | 3113 | 3114 |
| K274A | 274 | K | A | 0.32 | 0.01 | 3115 | 3116 |
| L954R | 954 | L | R | 0.32 | 0.06 | 3117 | 3118 |
| M603W | 603 | M | W | 0.32 | 0.1 | 3119 | 3120 |
| D631N | 631 | D | N | 0.32 | 0.14 | 3121 | 3122 |
| Y678A | 678 | Y | A | 0.32 | 0.73 | 3123 | 3124 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| K1121N | 1121 | K | N | 0.32 | 0.15 | 3125 | 3126 |
| E88V | 88 | E | V | 0.32 | 0.19 | 3127 | 3128 |
| K648P | 648 | K | P | 0.32 | 0.7 | 3129 | 3130 |
| T776Y | 776 | T | Y | 0.32 | 0.03 | 3131 | 3132 |
| K1026G | 1026 | K | G | 0.32 | 0.09 | 3133 | 3134 |
| R284V | 284 | R | V | 0.32 | 1.2 | 3135 | 3136 |
| Y827D | 827 | Y | D | 0.32 | 0.07 | 3137 | 3138 |
| D877G | 877 | D | G | 0.32 | 0.12 | 3139 | 3140 |
| E674C | 674 | E | C | 0.32 | 0.15 | 3141 | 3142 |
| S431L | 431 | S | L | 0.32 | 0.88 | 3143 | 3144 |
| S394H | 394 | S | H | 0.32 | 0.01 | 3145 | 3146 |
| Y781Q | 781 | Y | Q | 0.32 | 0.01 | 3147 | 3148 |
| K1121Y | 1121 | K | Y | 0.32 | 0.15 | 3149 | 3150 |
| I205V | 205 | I | V | 0.32 | 0.26 | 3151 | 3152 |
| R86A | 86 | R | A | 0.32 | 0.06 | 3153 | 3154 |
| L914A | 914 | L | A | 0.32 | 0.05 | 3155 | 3156 |
| L779S | 779 | L | S | 0.32 | 0.09 | 3157 | 3158 |
| Y872Q | 872 | Y | Q | 0.32 | 0.03 | 3159 | 3160 |
| T480E | 480 | T | E | 0.32 | 0.43 | 3161 | 3162 |
| K135V | 135 | K | V | 0.32 | 0.02 | 3163 | 3164 |
| A1113M | 1113 | A | M | 0.32 | 0.09 | 3165 | 3166 |
| R482A | 482 | R | A | 0.32 | 0.04 | 3167 | 3168 |
| D450A | 450 | D | A | 0.32 | 0.1 | 3169 | 3170 |
| Q703P | 703 | Q | P | 0.32 | 0.06 | 3171 | 3172 |
| A1181Q | 1181 | A | Q | 0.32 | 0.7 | 3173 | 3174 |
| V907A | 907 | V | A | 0.32 | 0.03 | 3175 | 3176 |
| D535E | 535 | D | E | 0.32 | 0.35 | 3177 | 3178 |
| E858M | 858 | E | M | 0.32 | 0.23 | 3179 | 3180 |
| S929Q | 929 | S | Q | 0.32 | 0.01 | 3181 | 3182 |
| G697R | 697 | G | R | 0.32 | 0.14 | 3183 | 3184 |
| N449C | 449 | N | C | 0.32 | 0.57 | 3185 | 3186 |
| M558H | 558 | M | H | 0.32 | 0.04 | 3187 | 3188 |
| Y294S | 294 | Y | S | 0.32 | 0.06 | 3189 | 3190 |
| E539L | 539 | E | L | 0.32 | 0.06 | 3191 | 3192 |
| Y294D | 294 | Y | D | 0.31 | 0.09 | 3193 | 3194 |
| Q941T | 941 | Q | T | 0.31 | 0.23 | 3195 | 3196 |
| F151L | 151 | F | L | 0.31 | 0.03 | 3197 | 3198 |
| N186Y | 186 | N | Y | 0.31 | 0.32 | 3199 | 3200 |
| P587S | 587 | P | S | 0.31 | 0.23 | 3201 | 3202 |
| D46F | 46 | D | F | 0.31 | 0.15 | 3203 | 3204 |
| E221W | 221 | E | W | 0.31 | 0.01 | 3205 | 3206 |
| I841Y | 841 | I | Y | 0.31 | 0.02 | 3207 | 3208 |
| S286K | 286 | S | K | 0.31 | 0.13 | 3209 | 3210 |
| D1207Y | 1207 | D | Y | 0.31 | 0.03 | 3211 | 3212 |
| K278Y | 278 | K | Y | 0.31 | 0.08 | 3213 | 3214 |
| L321K | 321 | L | K | 0.31 | 0.1 | 3215 | 3216 |
| F474V | 474 | F | V | 0.31 | 0.02 | 3217 | 3218 |
| N1077H | 1077 | N | H | 0.31 | 0.13 | 3219 | 3220 |
| E178L | 178 | E | L | 0.31 | 0.2 | 3221 | 3222 |
| L1065E | 1065 | L | E | 0.31 | 0.08 | 3223 | 3224 |
| Y77S | 77 | Y | S | 0.31 | 0.16 | 3225 | 3226 |
| D1207T | 1207 | D | T | 0.31 | 0.07 | 3227 | 3228 |
| N1166K | 1166 | N | K | 0.31 | 0.03 | 3229 | 3230 |
| Y670D | 670 | Y | D | 0.31 | 0.03 | 3231 | 3232 |
| N861Y | 861 | N | Y | 0.31 | 0.21 | 3233 | 3234 |
| E412P | 412 | E | P | 0.31 | 1.32 | 3235 | 3236 |
| E95W | 95 | E | W | 0.31 | 0.41 | 3237 | 3238 |
| D708A | 708 | D | A | 0.31 | 0.19 | 3239 | 3240 |
| S60T | 60 | S | T | 0.31 | 0.29 | 3241 | 3242 |
| K787Y | 787 | K | Y | 0.31 | 0.21 | 3243 | 3244 |
| Y700D | 700 | Y | D | 0.31 | 0.06 | 3245 | 3246 |
| A1201R | 1201 | A | R | 0.31 | 0.08 | 3247 | 3248 |
| A766V | 766 | A | V | 0.31 | 0.01 | 3249 | 3250 |
| D559Y | 559 | D | Y | 0.31 | 0.01 | 3251 | 3252 |
| E95T | 95 | E | T | 0.31 | 0.11 | 3253 | 3254 |
| A139R | 139 | A | R | 0.31 | 0.33 | 3255 | 3256 |
| D458T | 458 | D | T | 0.31 | 0.04 | 3257 | 3258 |
| K804L | 804 | K | L | 0.31 | 0.11 | 3259 | 3260 |
| Q941D | 941 | Q | D | 0.31 | 0.34 | 3261 | 3262 |
| A920G | 920 | A | G | 0.31 | 0.18 | 3263 | 3264 |
| Y381T | 381 | Y | T | 0.31 | 0.16 | 3265 | 3266 |
| K692Y | 692 | K | Y | 0.31 | 0.01 | 3267 | 3268 |
| D832E | 832 | D | E | 0.31 | 0.16 | 3269 | 3270 |
| T246A | 246 | T | A | 0.31 | 0.11 | 3271 | 3272 |
| Y237F | 237 | Y | F | 0.3 | 0.02 | 3273 | 3274 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| V842W | 842 | V | W | 0.3 | 0.32 | 3275 | 3276 |
| G668L | 668 | G | L | 0.3 | 0.17 | 3277 | 3278 |
| E695L | 695 | E | L | 0.3 | 0.11 | 3279 | 3280 |
| L132R | 132 | L | R | 0.3 | 0.12 | 3281 | 3282 |
| K775M | 775 | K | M | 0.3 | 0.24 | 3283 | 3284 |
| R158K | 158 | R | K | 0.3 | 0.65 | 3285 | 3286 |
| Y840L | 840 | Y | L | 0.3 | 0.3 | 3287 | 3288 |
| W890G | 890 | W | G | 0.3 | 0.05 | 3289 | 3290 |
| D437S | 437 | D | S | 0.3 | 0.47 | 3291 | 3292 |
| E858N | 858 | E | N | 0.3 | 0.19 | 3293 | 3294 |
| A1201S | 1201 | A | S | 0.3 | 0.64 | 3295 | 3296 |
| L1192G | 1192 | L | G | 0.3 | 0.25 | 3297 | 3298 |
| G576C | 576 | G | C | 0.3 | 0.2 | 3299 | 3300 |
| D877A | 877 | D | A | 0.3 | 0.04 | 3301 | 3302 |
| K1121M | 1121 | K | M | 0.3 | 0.1 | 3303 | 3304 |
| K1079Q | 1079 | K | Q | 0.3 | 0.13 | 3305 | 3306 |
| N157C | 157 | N | C | 0.3 | 0.34 | 3307 | 3308 |
| K979M | 979 | K | M | 0.3 | 0.65 | 3309 | 3310 |
| K199P | 199 | K | P | 0.3 | 0.14 | 3311 | 3312 |
| L414K | 414 | L | K | 0.3 | 0.01 | 3313 | 3314 |
| D297A | 297 | D | A | 0.3 | 0.07 | 3315 | 3316 |
| L738C | 738 | L | C | 0.3 | 0.26 | 3317 | 3318 |
| G475L | 475 | G | L | 0.3 | 0.21 | 3319 | 3320 |
| V411S | 411 | V | S | 0.3 | 0.02 | 3321 | 3322 |
| I318A | 318 | I | A | 0.3 | 1.18 | 3323 | 3324 |
| G335L | 335 | G | L | 0.3 | 0.08 | 3325 | 3326 |
| Y903S | 903 | Y | S | 0.3 | 0.2 | 3327 | 3328 |
| K1026H | 1026 | K | H | 0.3 | 0.01 | 3329 | 3330 |
| L914I | 914 | L | I | 0.3 | 0.01 | 3331 | 3332 |
| N955C | 955 | N | C | 0.3 | 1.51 | 3333 | 3334 |
| L1091R | 1091 | L | R | 0.3 | 0.07 | 3335 | 3336 |
| N63Q | 63 | N | Q | 0.3 | 0.15 | 3337 | 3338 |
| K1026D | 1026 | K | D | 0.3 | 0.19 | 3339 | 3340 |
| S1020P | 1020 | S | P | 0.3 | 0.08 | 3341 | 3342 |
| S1225W | 1225 | S | W | 0.3 | 0.05 | 3343 | 3344 |
| M949R | 949 | M | R | 0.3 | 0.1 | 3345 | 3346 |
| Y700R | 700 | Y | R | 0.3 | 0.54 | 3347 | 3348 |
| N327L | 327 | N | L | 0.3 | 0.12 | 3349 | 3350 |
| S982M | 982 | S | M | 0.3 | 0.09 | 3351 | 3352 |
| F19C | 19 | F | C | 0.3 | 0 | 3353 | 3354 |
| S780A | 780 | S | A | 0.3 | 0.01 | 3355 | 3356 |
| L839A | 839 | L | A | 0.29 | 0.01 | 3357 | 3358 |
| E981T | 981 | E | T | 0.29 | 0.21 | 3359 | 3360 |
| D283L | 283 | D | L | 0.29 | 0.05 | 3361 | 3362 |
| K269P | 269 | K | P | 0.29 | 0.46 | 3363 | 3364 |
| E981S | 981 | E | S | 0.29 | 0.02 | 3365 | 3366 |
| E88K | 88 | E | K | 0.29 | 0.02 | 3367 | 3368 |
| R86V | 86 | R | V | 0.29 | 0.14 | 3369 | 3370 |
| F81P | 81 | F | P | 0.29 | 0.17 | 3371 | 3372 |
| V193Q | 193 | V | Q | 0.29 | 0.05 | 3373 | 3374 |
| S1132C | 1132 | S | C | 0.29 | 0.7 | 3375 | 3376 |
| K1003D | 1003 | K | D | 0.29 | 0.18 | 3377 | 3378 |
| T480Y | 480 | T | Y | 0.29 | 0.06 | 3379 | 3380 |
| T1016Y | 1016 | T | Y | 0.29 | 0.12 | 3381 | 3382 |
| D283Q | 283 | D | Q | 0.29 | 0.34 | 3383 | 3384 |
| N356F | 356 | N | F | 0.29 | 0.09 | 3385 | 3386 |
| K372R | 372 | K | R | 0.29 | 0.44 | 3387 | 3388 |
| T778I | 778 | T | I | 0.29 | 0.3 | 3389 | 3390 |
| R82Y | 82 | R | Y | 0.29 | 0.05 | 3391 | 3392 |
| F328A | 328 | F | A | 0.29 | 0.26 | 3393 | 3394 |
| Y606E | 606 | Y | E | 0.29 | 0.09 | 3395 | 3396 |
| L97A | 97 | L | A | 0.29 | 0.03 | 3397 | 3398 |
| A1181R | 1181 | A | R | 0.29 | 0.32 | 3399 | 3400 |
| K265Y | 265 | K | Y | 0.29 | 0 | 3401 | 3402 |
| V574S | 574 | V | S | 0.29 | 0.54 | 3403 | 3404 |
| R102N | 102 | R | N | 0.29 | 0.05 | 3405 | 3406 |
| K536D | 536 | K | D | 0.29 | 0.39 | 3407 | 3408 |
| D926A | 926 | D | A | 0.29 | 0.21 | 3409 | 3410 |
| M1134Y | 1134 | M | Y | 0.29 | 0.11 | 3411 | 3412 |
| L927R | 927 | L | R | 0.29 | 0.12 | 3413 | 3414 |
| N1156T | 1156 | N | T | 0.29 | 0.24 | 3415 | 3416 |
| L94Y | 94 | L | Y | 0.29 | 0.21 | 3417 | 3418 |
| T480M | 480 | T | M | 0.29 | 0.18 | 3419 | 3420 |
| F702R | 702 | F | R | 0.29 | 0.18 | 3421 | 3422 |
| Y57D | 57 | Y | D | 0.29 | 0.14 | 3423 | 3424 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| L586I | 586 | L | I | 0.29 | 0.08 | 3425 | 3426 |
| K120Q | 120 | K | Q | 0.29 | 0.06 | 3427 | 3428 |
| Y183S | 183 | Y | S | 0.29 | 0.11 | 3429 | 3430 |
| G697A | 697 | G | A | 0.29 | 0.14 | 3431 | 3432 |
| N849H | 849 | N | H | 0.29 | 0.83 | 3433 | 3434 |
| K120T | 120 | K | T | 0.29 | 0.09 | 3435 | 3436 |
| K320Q | 320 | K | Q | 0.29 | 0.1 | 3437 | 3438 |
| G588L | 588 | G | L | 0.29 | 0.01 | 3439 | 3440 |
| L498K | 498 | L | K | 0.29 | 0.09 | 3441 | 3442 |
| N772P | 772 | N | P | 0.29 | 0.54 | 3443 | 3444 |
| Y1221L | 1221 | Y | L | 0.29 | 0.12 | 3445 | 3446 |
| R1144P | 1144 | R | P | 0.29 | 0.11 | 3447 | 3448 |
| I859L | 859 | I | L | 0.29 | 0.18 | 3449 | 3450 |
| F227Q | 227 | F | Q | 0.29 | 0.01 | 3451 | 3452 |
| L97H | 97 | L | H | 0.29 | 0.21 | 3453 | 3454 |
| V491R | 491 | V | R | 0.29 | 0.07 | 3455 | 3456 |
| Y1167L | 1167 | Y | L | 0.29 | 1.5 | 3457 | 3458 |
| N582Q | 582 | N | Q | 0.29 | 0.03 | 3459 | 3460 |
| Y956F | 956 | Y | F | 0.29 | 0.53 | 3461 | 3462 |
| T891R | 891 | T | R | 0.29 | 0.18 | 3463 | 3464 |
| N772C | 772 | N | C | 0.29 | 0.44 | 3465 | 3466 |
| S432G | 432 | S | G | 0.29 | 0.04 | 3467 | 3468 |
| F789V | 789 | F | V | 0.29 | 0.07 | 3469 | 3470 |
| K272R | 272 | K | R | 0.29 | 0.06 | 3471 | 3472 |
| E695Y | 695 | E | Y | 0.29 | 0.06 | 3473 | 3474 |
| F473C | 473 | F | C | 0.29 | 0.03 | 3475 | 3476 |
| K1050Y | 1050 | K | Y | 0.28 | 0.03 | 3477 | 3478 |
| N582H | 582 | N | H | 0.28 | 0.11 | 3479 | 3480 |
| G488A | 488 | G | A | 0.28 | 0.11 | 3481 | 3482 |
| G291W | 291 | G | W | 0.28 | 0.11 | 3483 | 3484 |
| D156A | 156 | D | A | 0.28 | 0.11 | 3485 | 3486 |
| F131D | 131 | F | D | 0.28 | 0.05 | 3487 | 3488 |
| K1015N | 1015 | K | N | 0.28 | 0.1 | 3489 | 3490 |
| I911C | 911 | I | C | 0.28 | 0.05 | 3491 | 3492 |
| F1198M | 1198 | F | M | 0.28 | 0.15 | 3493 | 3494 |
| S929I | 929 | S | I | 0.28 | 0.14 | 3495 | 3496 |
| N1081C | 1081 | N | C | 0.28 | 0.07 | 3497 | 3498 |
| F144R | 144 | F | R | 0.28 | 0.04 | 3499 | 3500 |
| K265E | 265 | K | E | 0.28 | 0.06 | 3501 | 3502 |
| K265F | 265 | K | F | 0.28 | 0.05 | 3503 | 3504 |
| E330H | 330 | E | H | 0.28 | 0.02 | 3505 | 3506 |
| E217V | 217 | E | V | 0.28 | 0.19 | 3507 | 3508 |
| I1111P | 1111 | I | P | 0.28 | 0.11 | 3509 | 3510 |
| A998R | 998 | A | R | 0.28 | 1.08 | 3511 | 3512 |
| N772T | 772 | N | T | 0.28 | 0.15 | 3513 | 3514 |
| F151N | 151 | F | N | 0.28 | 0.06 | 3515 | 3516 |
| N590K | 590 | N | K | 0.28 | 0.2 | 3517 | 3518 |
| S185G | 185 | S | G | 0.28 | 0.21 | 3519 | 3520 |
| T1019F | 1019 | T | F | 0.28 | 0.08 | 3521 | 3522 |
| E815W | 815 | E | W | 0.28 | 0.25 | 3523 | 3524 |
| F474D | 474 | F | D | 0.28 | 0.13 | 3525 | 3526 |
| W1218F | 1218 | W | F | 0.28 | 0.65 | 3527 | 3528 |
| N1081F | 1081 | N | F | 0.28 | 0.11 | 3529 | 3530 |
| D1146E | 1146 | D | E | 0.28 | 0.2 | 3531 | 3532 |
| Y294M | 294 | Y | M | 0.28 | 0.06 | 3533 | 3534 |
| N1182Q | 1182 | N | Q | 0.28 | 0.28 | 3535 | 3536 |
| I496M | 496 | I | M | 0.28 | 0.04 | 3537 | 3538 |
| Y562H | 562 | Y | H | 0.28 | 0.11 | 3539 | 3540 |
| Y616C | 616 | Y | C | 0.28 | 0.15 | 3541 | 3542 |
| Y1124E | 1124 | Y | E | 0.28 | 0.12 | 3543 | 3544 |
| S296D | 296 | S | D | 0.28 | 0.02 | 3545 | 3546 |
| G830I | 830 | G | I | 0.28 | 1.5 | 3547 | 3548 |
| S1132G | 1132 | S | G | 0.28 | 0.47 | 3549 | 3550 |
| E130W | 130 | E | W | 0.28 | 0.14 | 3551 | 3552 |
| T814H | 814 | T | H | 0.28 | 0.08 | 3553 | 3554 |
| N1178S | 1178 | N | S | 0.28 | 0.1 | 3555 | 3556 |
| D541E | 541 | D | E | 0.28 | 0.12 | 3557 | 3558 |
| T85L | 85 | T | L | 0.28 | 0.05 | 3559 | 3560 |
| G902L | 902 | G | L | 0.28 | 0.18 | 3561 | 3562 |
| R182S | 182 | R | S | 0.28 | 0.08 | 3563 | 3564 |
| D919A | 919 | D | A | 0.28 | 0.12 | 3565 | 3566 |
| D1032E | 1032 | D | E | 0.28 | 0.06 | 3567 | 3568 |
| Y494K | 494 | Y | K | 0.28 | 0.02 | 3569 | 3570 |
| S14M | 14 | S | M | 0.28 | 0.11 | 3571 | 3572 |
| E379Y | 379 | E | Y | 0.28 | 0.21 | 3573 | 3574 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| E302P | 302 | E | P | 0.28 | 0.21 | 3575 | 3576 |
| N651D | 651 | N | D | 0.28 | 0.19 | 3577 | 3578 |
| N577L | 577 | N | L | 0.28 | 0.01 | 3579 | 3580 |
| D407P | 407 | D | P | 0.28 | 0.26 | 3581 | 3582 |
| N481Q | 481 | N | Q | 0.28 | 0.22 | 3583 | 3584 |
| E90R | 90 | E | R | 0.28 | 0.09 | 3585 | 3586 |
| I643S | 643 | I | S | 0.28 | 0.09 | 3587 | 3588 |
| I736K | 736 | I | K | 0.28 | 1.5 | 3589 | 3590 |
| E207A | 207 | E | A | 0.28 | 0.07 | 3591 | 3592 |
| I831M | 831 | I | M | 0.28 | 0.2 | 3593 | 3594 |
| Y524G | 524 | Y | G | 0.28 | 0.4 | 3595 | 3596 |
| K1017V | 1017 | K | V | 0.28 | 0.1 | 3597 | 3598 |
| A150I | 150 | A | I | 0.28 | 0.29 | 3599 | 3600 |
| K110R | 110 | K | R | 0.28 | 0.09 | 3601 | 3602 |
| R867T | 867 | R | T | 0.28 | 1.19 | 3603 | 3604 |
| I189Q | 189 | I | Q | 0.28 | 0.03 | 3605 | 3606 |
| L1192N | 1192 | L | N | 0.28 | 0.05 | 3607 | 3608 |
| I196G | 196 | I | G | 0.28 | 0.11 | 3609 | 3610 |
| K1017P | 1017 | K | P | 0.28 | 0.33 | 3611 | 3612 |
| I831R | 831 | I | R | 0.28 | 1.19 | 3613 | 3614 |
| T1019L | 1019 | T | L | 0.28 | 0.1 | 3615 | 3616 |
| S212R | 212 | S | R | 0.28 | 0.2 | 3617 | 3618 |
| K538Y | 538 | K | Y | 0.28 | 0.41 | 3619 | 3620 |
| A556S | 556 | A | S | 0.28 | 0.1 | 3621 | 3622 |
| P528N | 528 | P | N | 0.28 | 0.07 | 3623 | 3624 |
| G254K | 254 | G | K | 0.28 | 0.21 | 3625 | 3626 |
| T230Y | 230 | T | Y | 0.28 | 0.18 | 3627 | 3628 |
| K1015A | 1015 | K | A | 0.28 | 0.03 | 3629 | 3630 |
| G475P | 475 | G | P | 0.28 | 0.06 | 3631 | 3632 |
| S987Q | 987 | S | Q | 0.27 | 0.5 | 3633 | 3634 |
| E467I | 467 | E | I | 0.27 | 0.52 | 3635 | 3636 |
| A108C | 108 | A | C | 0.27 | 0.3 | 3637 | 3638 |
| I184K | 184 | I | K | 0.27 | 0.13 | 3639 | 3640 |
| E579G | 579 | E | G | 0.27 | 0 | 3641 | 3642 |
| W1063Y | 1063 | W | Y | 0.27 | 0.21 | 3643 | 3644 |
| L140R | 140 | L | R | 0.27 | 0.03 | 3645 | 3646 |
| K595I | 595 | K | I | 0.27 | 0.22 | 3647 | 3648 |
| F81K | 81 | F | K | 0.27 | 0.14 | 3649 | 3650 |
| E299M | 299 | E | M | 0.27 | 0.21 | 3651 | 3652 |
| D1023R | 1023 | D | R | 0.27 | 0.21 | 3653 | 3654 |
| P997I | 997 | P | I | 0.27 | 0.21 | 3655 | 3656 |
| F669V | 669 | F | V | 0.27 | 0.11 | 3657 | 3658 |
| L744D | 744 | L | D | 0.27 | 0.21 | 3659 | 3660 |
| L498F | 498 | L | F | 0.27 | 0.09 | 3661 | 3662 |
| K1079I | 1079 | K | I | 0.27 | 0.05 | 3663 | 3664 |
| E539K | 539 | E | K | 0.27 | 0.38 | 3665 | 3666 |
| F328V | 328 | F | V | 0.27 | 0.05 | 3667 | 3668 |
| I557H | 557 | I | H | 0.27 | 0.05 | 3669 | 3670 |
| L261D | 261 | L | D | 0.27 | 0.06 | 3671 | 3672 |
| I62S | 62 | I | S | 0.27 | 0.01 | 3673 | 3674 |
| N837Q | 837 | N | Q | 0.27 | 0.19 | 3675 | 3676 |
| T778A | 778 | T | A | 0.27 | 0.08 | 3677 | 3678 |
| E479V | 479 | E | V | 0.27 | 0.02 | 3679 | 3680 |
| K1025H | 1025 | K | H | 0.27 | 0.05 | 3681 | 3682 |
| I234R | 234 | I | R | 0.27 | 0.04 | 3683 | 3684 |
| S609T | 609 | S | T | 0.27 | 0.23 | 3685 | 3686 |
| M1035H | 1035 | M | H | 0.27 | 0.05 | 3687 | 3688 |
| Y494R | 494 | Y | R | 0.27 | 0.07 | 3689 | 3690 |
| D122P | 122 | D | P | 0.27 | 0.05 | 3691 | 3692 |
| F530C | 530 | F | C | 0.27 | 0.19 | 3693 | 3694 |
| F627H | 627 | F | H | 0.27 | 0.21 | 3695 | 3696 |
| Y262V | 262 | Y | V | 0.27 | 0.07 | 3697 | 3698 |
| I392R | 392 | I | R | 0.27 | 0.29 | 3699 | 3700 |
| V1037M | 1037 | V | M | 0.27 | 0.34 | 3701 | 3702 |
| C805N | 805 | C | N | 0.27 | 0.01 | 3703 | 3704 |
| Y214T | 214 | Y | T | 0.27 | 0 | 3705 | 3706 |
| E683Y | 683 | E | Y | 0.27 | 0.01 | 3707 | 3708 |
| I736T | 736 | I | T | 0.27 | 0.65 | 3709 | 3710 |
| D297E | 297 | D | E | 0.27 | 0.1 | 3711 | 3712 |
| I418T | 418 | I | T | 0.27 | 0.2 | 3713 | 3714 |
| T814R | 814 | T | R | 0.27 | 0.13 | 3715 | 3716 |
| L856S | 856 | L | S | 0.27 | 0.19 | 3717 | 3718 |
| K427C | 427 | K | C | 0.27 | 0.09 | 3719 | 3720 |
| A901D | 901 | A | D | 0.27 | 0.49 | 3721 | 3722 |
| K391Q | 391 | K | Q | 0.27 | 0.26 | 3723 | 3724 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| V783F | 783 | V | F | 0.27 | 0.18 | 3725 | 3726 |
| G335E | 335 | G | E | 0.27 | 0.25 | 3727 | 3728 |
| K917Q | 917 | K | Q | 0.27 | 0.11 | 3729 | 3730 |
| E795C | 795 | E | C | 0.27 | 0.17 | 3731 | 3732 |
| F197E | 197 | F | E | 0.27 | 0.27 | 3733 | 3734 |
| F1027D | 1027 | F | D | 0.27 | 0.16 | 3735 | 3736 |
| L1150F | 1150 | L | F | 0.27 | 0.27 | 3737 | 3738 |
| S686Q | 686 | S | Q | 0.26 | 0.44 | 3739 | 3740 |
| L37D | 37 | L | D | 0.26 | 0.32 | 3741 | 3742 |
| T480H | 480 | T | H | 0.26 | 0.14 | 3743 | 3744 |
| E743Q | 743 | E | Q | 0.26 | 0.14 | 3745 | 3746 |
| K107L | 107 | K | L | 0.26 | 0.01 | 3747 | 3748 |
| N808P | 808 | N | P | 0.26 | 0 | 3749 | 3750 |
| K564S | 564 | K | S | 0.26 | 0.09 | 3751 | 3752 |
| N803H | 803 | N | H | 0.26 | 0.11 | 3753 | 3754 |
| S1020F | 1020 | S | F | 0.26 | 0.01 | 3755 | 3756 |
| I1104T | 1104 | I | T | 0.26 | 0.49 | 3757 | 3758 |
| N306W | 306 | N | W | 0.26 | 0.05 | 3759 | 3760 |
| D1120E | 1120 | D | E | 0.26 | 0.03 | 3761 | 3762 |
| D1146Q | 1146 | D | Q | 0.26 | 0.08 | 3763 | 3764 |
| R1073Y | 1073 | R | Y | 0.26 | 0.34 | 3765 | 3766 |
| Y872S | 872 | Y | S | 0.26 | 0.01 | 3767 | 3768 |
| Y429H | 429 | Y | H | 0.26 | 0.33 | 3769 | 3770 |
| D423R | 423 | D | R | 0.26 | 0.2 | 3771 | 3772 |
| K785I | 785 | K | I | 0.26 | 0.54 | 3773 | 3774 |
| E299A | 299 | E | A | 0.26 | 0.14 | 3775 | 3776 |
| W1218Q | 1218 | W | Q | 0.26 | 0.13 | 3777 | 3778 |
| G846Y | 846 | G | Y | 0.26 | 0.39 | 3779 | 3780 |
| A761R | 761 | A | R | 0.26 | 0.88 | 3781 | 3782 |
| K940S | 940 | K | S | 0.26 | 0.01 | 3783 | 3784 |
| N1081L | 1081 | N | L | 0.26 | 0.28 | 3785 | 3786 |
| S1225F | 1225 | S | F | 0.26 | 0.06 | 3787 | 3788 |
| I318L | 318 | I | L | 0.26 | 0.1 | 3789 | 3790 |
| F980V | 980 | F | V | 0.26 | 0.11 | 3791 | 3792 |
| P826D | 826 | P | D | 0.26 | 0.15 | 3793 | 3794 |
| E981L | 981 | E | L | 0.26 | 0.27 | 3795 | 3796 |
| S1132L | 1132 | S | L | 0.26 | 0.01 | 3797 | 3798 |
| T777W | 777 | T | W | 0.26 | 0.1 | 3799 | 3800 |
| A604Q | 604 | A | Q | 0.26 | 0.13 | 3801 | 3802 |
| D283K | 283 | D | K | 0.26 | 0.54 | 3803 | 3804 |
| D637K | 637 | D | K | 0.26 | 0.1 | 3805 | 3806 |
| K72Y | 72 | K | Y | 0.26 | 0.02 | 3807 | 3808 |
| E130A | 130 | E | A | 0.26 | 1 | 3809 | 3810 |
| T1145E | 1145 | T | E | 0.26 | 0.44 | 3811 | 3812 |
| N803T | 803 | N | T | 0.26 | 0.01 | 3813 | 3814 |
| F225C | 225 | F | C | 0.26 | 0.19 | 3815 | 3816 |
| E925S | 925 | E | S | 0.26 | 0.14 | 3817 | 3818 |
| N356H | 356 | N | H | 0.26 | 0.11 | 3819 | 3820 |
| S79F | 79 | S | F | 0.26 | 0.39 | 3821 | 3822 |
| N1156H | 1156 | N | H | 0.26 | 0 | 3823 | 3824 |
| I831S | 831 | I | S | 0.26 | 0.19 | 3825 | 3826 |
| Q853M | 853 | Q | M | 0.26 | 0.26 | 3827 | 3828 |
| T540Q | 540 | T | Q | 0.26 | 0 | 3829 | 3830 |
| A1094D | 1094 | A | D | 0.26 | 0.27 | 3831 | 3832 |
| E232R | 232 | E | R | 0.26 | 0.16 | 3833 | 3834 |
| G242L | 242 | G | L | 0.26 | 0.34 | 3835 | 3836 |
| K1079L | 1079 | K | L | 0.26 | 0.29 | 3837 | 3838 |
| M1137R | 1137 | M | R | 0.26 | 0.09 | 3839 | 3840 |
| I996G | 996 | I | G | 0.26 | 0.11 | 3841 | 3842 |
| M603A | 603 | M | A | 0.26 | 0.02 | 3843 | 3844 |
| S1132F | 1132 | S | F | 0.26 | 0.57 | 3845 | 3846 |
| V38L | 38 | V | L | 0.26 | 0.24 | 3847 | 3848 |
| V908M | 908 | V | M | 0.26 | 0.16 | 3849 | 3850 |
| D122V | 122 | D | V | 0.26 | 0.13 | 3851 | 3852 |
| L856V | 856 | L | V | 0.26 | 0.07 | 3853 | 3854 |
| I904L | 904 | I | L | 0.26 | 0.04 | 3855 | 3856 |
| W1063D | 1063 | W | D | 0.26 | 0.16 | 3857 | 3858 |
| F1149I | 1149 | F | I | 0.26 | 0.1 | 3859 | 3860 |
| R883T | 883 | R | T | 0.26 | 0 | 3861 | 3862 |
| C1116E | 1116 | C | E | 0.26 | 0.07 | 3863 | 3864 |
| Y494M | 494 | Y | M | 0.26 | 0 | 3865 | 3866 |
| D407R | 407 | D | R | 0.26 | 0.07 | 3867 | 3868 |
| K89V | 89 | K | V | 0.26 | 0.02 | 3869 | 3870 |
| Q735P | 735 | Q | P | 0.26 | 0.69 | 3871 | 3872 |
| K1017M | 1017 | K | M | 0.26 | 0.06 | 3873 | 3874 |

TABLE 2-continued

Lachnospiraceae bacterium ND2006 Cas12a Wild-type and Mutants

| Mutation | Position | WT residue | Mutant residue | Average score | Standard deviation | NT SEQ ID | AA SEQ ID |
|---|---|---|---|---|---|---|---|
| A1022H | 1022 | A | H | 0.26 | 0.26 | 3875 | 3876 |
| S739C | 739 | S | C | 0.26 | 0.04 | 3877 | 3878 |
| H759K | 759 | H | K | 0.26 | 0.54 | 3879 | 3880 |
| Y11D | 11 | Y | D | 0.26 | 0.06 | 3881 | 3882 |
| I138K | 138 | I | K | 0.25 | 0.11 | 3883 | 3884 |
| I1111Q | 1111 | I | Q | 0.25 | 0.12 | 3885 | 3886 |
| R1144G | 1144 | R | G | 0.25 | 0.18 | 3887 | 3888 |
| I800L | 800 | I | L | 0.25 | 0.15 | 3889 | 3890 |
| D1148E | 1148 | D | E | 0.25 | 0.17 | 3891 | 3892 |
| D40N | 40 | D | N | 0.25 | 0.06 | 3893 | 3894 |
| G1196F | 1196 | G | F | 0.25 | 0.01 | 3895 | 3896 |
| V844R | 844 | V | R | 0.25 | 0.32 | 3897 | 3898 |
| L459Q | 459 | L | Q | 0.25 | 0.01 | 3899 | 3900 |
| D32E | 32 | D | E | 0.25 | 0.02 | 3901 | 3902 |
| E382F | 382 | E | F | 0.25 | 0.16 | 3903 | 3904 |
| S394P | 394 | S | P | 0.25 | 0.08 | 3905 | 3906 |
| N928C | 928 | N | C | 0.25 | 0.24 | 3907 | 3908 |
| H759P | 759 | H | P | 0.25 | 0.14 | 3909 | 3910 |
| Y854D | 854 | Y | D | 0.25 | 0.03 | 3911 | 3912 |
| D423Q | 423 | D | Q | 0.25 | 0.25 | 3913 | 3914 |
| N356T | 356 | N | T | 0.25 | 0.1 | 3915 | 3916 |
| D708E | 708 | D | E | 0.25 | 0.12 | 3917 | 3918 |
| N864F | 864 | N | F | 0.25 | 0.1 | 3919 | 3920 |
| T1019Y | 1019 | T | Y | 0.25 | 0.09 | 3921 | 3922 |
| R86M | 86 | R | M | 0.25 | 0.04 | 3923 | 3924 |
| F131C | 131 | F | C | 0.25 | 0.15 | 3925 | 3926 |
| N1082H | 1082 | N | H | 0.25 | 0.09 | 3927 | 3928 |
| D40S | 40 | D | S | 0.25 | 2.12 | 3929 | 3930 |
| D461A | 461 | D | A | 0.25 | 0.22 | 3931 | 3932 |
| E88H | 88 | E | H | 0.25 | 0.11 | 3933 | 3934 |
| A766N | 766 | A | N | 0.25 | 0.44 | 3935 | 3936 |
| V491S | 491 | V | S | 0.25 | 0.07 | 3937 | 3938 |
| E330R | 330 | E | R | 0.25 | 0.16 | 3939 | 3940 |
| F173V | 173 | F | V | 0.25 | 0.11 | 3941 | 3942 |
| Q567S | 567 | Q | S | 0.25 | 0.49 | 3943 | 3944 |
| V574P | 574 | V | P | 0.25 | 0 | 3945 | 3946 |
| K413C | 413 | K | C | 0.25 | 0.54 | 3947 | 3948 |
| D535A | 535 | D | A | 0.25 | 0.11 | 3949 | 3950 |
| P964Q | 964 | P | Q | 0.25 | 0.05 | 3951 | 3952 |
| S143K | 143 | S | K | 0.25 | 0.01 | 3953 | 3954 |
| L751H | 751 | L | H | 0.25 | 0.44 | 3955 | 3956 |

TABLE 3

Primers for creating LbCas12a Saturation Mutagenesis Library

| Name | Sequence (5'→3') | SEQ ID NO |
|---|---|---|
| LbCas12a_NNK_1 | tataagaaggagatatacatNNKAGCAAACTGGAAAAGTTCAC | 4023 |
| LbCas12a_NNK_2 | aagaaggagatatacatatgNNKAAACTGGAAAAGTTCACCAA | 4024 |
| LbCas12a_NNK_3 | aaggagatatacatatgAGCNNKCTGGAAAAGTTCACCAACTG | 4025 |
| LbCas12a_NNK_4 | gagatatacatatgAGCAAANNKGAAAAGTTCACCAACTGTTA | 4026 |
| LbCas12a_NNK_5 | atatacatatgAGCAAACTGNNKAAGTTCACCAACTGTTATAG | 4027 |
| LbCas12a_NNK_6 | tacatatgAGCAAACTGGAANNKTTCACCAACTGTTATAGCCT | 4028 |
| LbCas12a_NNK_7 | atatgAGCAAACTGGAAAAGNNKACCAACTGTTATAGCCTGAG | 4029 |
| LbCas12a_NNK_8 | tgAGCAAACTGGAAAAGTTCNNKAACTGTTATAGCCTGAGCAA | 4030 |
| LbCas12a_NNK_9 | GCAAACTGGAAAAGTTCACCNNKTGTTATAGCCTGAGCAAAAC | 4031 |
| LbCas12a_NNK_10 | AACTGGAAAAGTTCACCAACNNKTATAGCCTGAGCAAAACCCT | 4032 |
| LbCas12a_NNK_11 | TGGAAAAGTTCACCAACTGTNNKAGCCTGAGCAAAACCCTGCG | 4033 |
| LbCas12a_NNK_12 | AAAAGTTCACCAACTGTTATNNKCTGAGCAAAACCCTGCGTTT | 4034 |

TABLE 3-continued

Primers for creating LbCas12a Saturation Mutagenesis Library

| Name | Sequence (5'→3') | SEQ ID NO |
|---|---|---|
| LbCas12a_NNK_13 | AGTTCACCAACTGTTATAGCNNKAGCAAAACCCTGCGTTTTAA | 4035 |
| LbCas12a_NNK_14 | TCACCAACTGTTATAGCCTGNNKAAAACCCTGCGTTTTAAAGC | 4036 |
| LbCas12a_NNK_15 | CCAACTGTTATAGCCTGAGCNNKACCCTGCGTTTTAAAGCAAT | 4037 |
| LbCas12a_NNK_16 | ACTGTTATAGCCTGAGCAAANNKCTGCGTTTTAAAGCAATTCC | 4038 |
| LbCas12a_NNK_17 | GTTATAGCCTGAGCAAAACCNNKCGTTTTAAAGCAATTCCGGT | 4039 |
| LbCas12a_NNK_18 | ATAGCCTGAGCAAAACCCTGNNKTTTAAAGCAATTCCGGTTGG | 4040 |
| LbCas12a_NNK_19 | GCCTGAGCAAAACCCTGCGTNNKAAAGCAATTCCGGTTGGTAA | 4041 |
| LbCas12a_NNK_20 | TGAGCAAAACCCTGCGTTTTNNKGCAATTCCGGTTGGTAAAAC | 4042 |
| LbCas12a_NNK_21 | GCAAAACCCTGCGTTTTAAANNKATTCCGGTTGGTAAAACCCA | 4043 |
| LbCas12a_NNK_22 | AAACCCTGCGTTTTAAAGCANNKCCGGTTGGTAAAACCCAAGA | 4044 |
| LbCas12a_NNK_23 | CCCTGCGTTTTAAAGCAATTNNKGTTGGTAAAACCCAAGAGAA | 4045 |
| LbCas12a_NNK_24 | TGCGTTTTAAAGCAATTCCGNNKGGTAAAACCCAAGAGAACAT | 4046 |
| LbCas12a_NNK_25 | GTTTTAAAGCAATTCCGGTTNNKAAAACCCAAGAGAACATTGA | 4047 |
| LbCas12a_NNK_26 | TTAAAGCAATTCCGGTTGGTNNKACCCAAGAGAACATTGATAA | 4048 |
| LbCas12a_NNK_27 | AAGCAATTCCGGTTGGTAAANNKCAAGAGAACATTGATAATAA | 4049 |
| LbCas12a_NNK_28 | CAATTCCGGTTGGTAAAACCNNKGAGAACATTGATAATAAACG | 4050 |
| LbCas12a_NNK_29 | TTCCGGTTGGTAAAACCCAANNKAACATTGATAATAAACGCCT | 4051 |
| LbCas12a_NNK_30 | CGGTTGGTAAAACCCAAGAGNNKATTGATAATAAACGCCTGCT | 4052 |
| LbCas12a_NNK_31 | TTGGTAAAACCCAAGAGAACNNKGATAATAAACGCCTGCTGGT | 4053 |
| LbCas12a_NNK_32 | GTAAAACCCAAGAGAACATTNNKAATAAACGCCTGCTGGTCGA | 4054 |
| LbCas12a_NNK_33 | AAACCCAAGAGAACATTGATNNKAAACGCCTGCTGGTCGAAGA | 4055 |
| LbCas12a_NNK_34 | CCCAAGAGAACATTGATAATNNKCGCCTGCTGGTCGAAGATGA | 4056 |
| LbCas12a_NNK_35 | AAGAGAACATTGATAATAAANNKCTGCTGGTCGAAGATGAAAA | 4057 |
| LbCas12a_NNK_36 | AGAACATTGATAATAAACGCNNKCTGGTCGAAGATGAAAAACG | 4058 |
| LbCas12a_NNK_37 | ACATTGATAATAAACGCCTGNNKGTCGAAGATGAAAAACGCGC | 4059 |
| LbCas12a_NNK_38 | TTGATAATAAACGCCTGCTGNNKGAAGATGAAAAACGCGCTGA | 4060 |
| LbCas12a_NNK_39 | ATAATAAACGCCTGCTGGTCNNKGATGAAAAACGCGCTGAAGA | 4061 |
| LbCas12a_NNK_40 | ATAAACGCCTGCTGGTCGAANNKGAAAAACGCGCTGAAGATTA | 4062 |
| LbCas12a_NNK_41 | AACGCCTGCTGGTCGAAGATNNKAAACGCGCTGAAGATTATAA | 4063 |
| LbCas12a_NNK_42 | GCCTGCTGGTCGAAGATGAANNKCGCGCTGAAGATTATAAAGG | 4064 |
| LbCas12a_NNK_43 | TGCTGGTCGAAGATGAAAAANNKGCTGAAGATTATAAAGGCGT | 4065 |
| LbCas12a_NNK_44 | TGGTCGAAGATGAAAAACGCNNKGAAGATTATAAAGGCGTGAA | 4066 |
| LbCas12a_NNK_45 | TCGAAGATGAAAAACGCGCTNNKGATTATAAAGGCGTGAAAAA | 4067 |
| LbCas12a_NNK_46 | AAGATGAAAAACGCGCTGAANNKTATAAAGGCGTGAAAAAACT | 4068 |
| LbCas12a_NNK_47 | ATGAAAAACGCGCTGAAGATNNKAAAGGCGTGAAAAAACTGCT | 4069 |
| LbCas12a_NNK_48 | AAAAACGCGCTGAAGATTATNNKGGCGTGAAAAAACTGCTGGA | 4070 |
| LbCas12a_NNK_49 | AACGCGCTGAAGATTATAAANNKGTGAAAAAACTGCTGGATCG | 4071 |

TABLE 3-continued

Primers for creating LbCas12a Saturation Mutagenesis Library

| Name | Sequence (5'→3') | SEQ ID NO |
|---|---|---|
| LbCas12a_NNK_50 | GCGCTGAAGATTATAAAGGCNNKAAAAAACTGCTGGATCGCTA | 4072 |
| LbCas12a_NNK_51 | CTGAAGATTATAAAGGCGTGNNKAAACTGCTGGATCGCTATTA | 4073 |
| LbCas12a_NNK_52 | AAGATTATAAAGGCGTGAAANNKCTGCTGGATCGCTATTATCT | 4074 |
| LbCas12a_NNK_53 | ATTATAAAGGCGTGAAAAAANNKCTGGATCGCTATTATCTGAG | 4075 |
| LbCas12a_NNK_54 | ATAAAGGCGTGAAAAAACTGNNKGATCGCTATTATCTGAGCTT | 4076 |
| LbCas12a_NNK_55 | AAGGCGTGAAAAAACTGCTGNNKCGCTATTATCTGAGCTTCAT | 4077 |
| LbCas12a_NNK_56 | GCGTGAAAAAACTGCTGGATNNKTATTATCTGAGCTTCATTAA | 4078 |
| LbCas12a_NNK_57 | TGAAAAAACTGCTGGATCGCNNKTATCTGAGCTTCATTAACGA | 4079 |
| LbCas12a_NNK_58 | AAAAACTGCTGGATCGCTATNNKCTGAGCTTCATTAACGATGT | 4080 |
| LbCas12a_NNK_59 | AACTGCTGGATCGCTATTATNNKAGCTTCATTAACGATGTGCT | 4081 |
| LbCas12a_NNK_60 | TGCTGGATCGCTATTATCTGNNKTTCATTAACGATGTGCTGCA | 4082 |
| LbCas12a_NNK_61 | TGGATCGCTATTATCTGAGCNNKATTAACGATGTGCTGCACAG | 4083 |
| LbCas12a_NNK_62 | ATCGCTATTATCTGAGCTTCNNKAACGATGTGCTGCACAGCAT | 4084 |
| LbCas12a_NNK_63 | GCTATTATCTGAGCTTCATTNNKGATGTGCTGCACAGCATTAA | 4085 |
| LbCas12a_NNK_64 | ATTATCTGAGCTTCATTAACNNKGTGCTGCACAGCATTAAACT | 4086 |
| LbCas12a_NNK_65 | ATCTGAGCTTCATTAACGATNNKCTGCACAGCATTAAACTGAA | 4087 |
| LbCas12a_NNK_66 | TGAGCTTCATTAACGATGTGNNKCACAGCATTAAACTGAAGAA | 4088 |
| LbCas12a_NNK_67 | GCTTCATTAACGATGTGCTGNNKAGCATTAAACTGAAGAACCT | 4089 |
| LbCas12a_NNK_68 | TCATTAACGATGTGCTGCACNNKATTAAACTGAAGAACCTGAA | 4090 |
| LbCas12a_NNK_69 | TTAACGATGTGCTGCACAGCNNKAAACTGAAGAACCTGAACAA | 4091 |
| LbCas12a_NNK_70 | ACGATGTGCTGCACAGCATTNNKCTGAAGAACCTGAACAACTA | 4092 |
| LbCas12a_NNK_71 | ATGTGCTGCACAGCATTAAANNKAAGAACCTGAACAACTATAT | 4093 |
| LbCas12a_NNK_72 | TGCTGCACAGCATTAAACTGNNKAACCTGAACAACTATATCAG | 4094 |
| LbCas12a_NNK_73 | TGCACAGCATTAAACTGAAGNNKCTGAACAACTATATCAGCCT | 4095 |
| LbCas12a_NNK_74 | ACAGCATTAAACTGAAGAACNNKAACAACTATATCAGCCTGTT | 4096 |
| LbCas12a_NNK_75 | GCATTAAACTGAAGAACCTGNNKAACTATATCAGCCTGTTTCG | 4097 |
| LbCas12a_NNK_76 | TTAAACTGAAGAACCTGAACNNKTATATCAGCCTGTTTCGTAA | 4098 |
| LbCas12a_NNK_77 | AACTGAAGAACCTGAACAACNNKATCAGCCTGTTTCGTAAAAA | 4099 |
| LbCas12a_NNK_78 | TGAAGAACCTGAACAACTATNNKAGCCTGTTTCGTAAAAAAAC | 4100 |
| LbCas12a_NNK_79 | AGAACCTGAACAACTATATCNNKCTGTTTCGTAAAAAAACCCG | 4101 |
| LbCas12a_NNK_80 | ACCTGAACAACTATATCAGCNNKTTTCGTAAAAAAACCCGCAC | 4102 |
| LbCas12a_NNK_81 | TGAACAACTATATCAGCCTGNNKCGTAAAAAAACCCGCACCGA | 4103 |
| LbCas12a_NNK_82 | ACAACTATATCAGCCTGTTTNNKAAAAAAACCCGCACCGAAAA | 4104 |
| LbCas12a_NNK_83 | ACTATATCAGCCTGTTTCGTNNKAAACCCGCACCGAAAAGA | 4105 |
| LbCas12a_NNK_84 | ATATCAGCCTGTTTCGTAAANNKACCCGCACCGAAAAGAAAA | 4106 |
| LbCas12a_NNK_85 | TCAGCCTGTTTCGTAAAAAANNKCGCACCGAAAAGAAAACAA | 4107 |
| LbCas12a_NNK_86 | GCCTGTTTCGTAAAAAAACCNNKACCGAAAAGAAAACAAAGA | 4108 |
| LbCas12a_NNK_87 | TGTTTCGTAAAAAAACCCGCNNKGAAAAGAAAACAAAGAGCT | 4109 |

TABLE 3-continued

Primers for creating LbCas12a Saturation Mutagenesis Library

| Name | Sequence (5'→3') | SEQ ID NO |
|---|---|---|
| LbCas12a_NNK_88 | TTCGTAAAAAAACCCGCACCNNKAAAGAAAACAAAGAGCTGGA | 4110 |
| LbCas12a_NNK_89 | GTAAAAAAACCCGCACCGAANNKGAAAACAAAGAGCTGGAAAA | 4111 |
| LbCas12a_NNK_90 | AAAAAACCCGCACCGAAAAANNKAACAAAGAGCTGGAAAACCT | 4112 |
| LbCas12a_NNK_91 | AAACCCGCACCGAAAAAGAANNKAAAGAGCTGGAAAACCTGGA | 4113 |
| LbCas12a_NNK_92 | CCCGCACCGAAAAAGAAAACNNKGAGCTGGAAAACCTGGAAAT | 4114 |
| LbCas12a_NNK_93 | GCACCGAAAAAGAAAACAAANNKCTGGAAAACCTGGAAATCAA | 4115 |
| LbCas12a_NNK_94 | cCGAAAAAGAAAACAAAGAGNNKGAAAACCTGGAAATCAATCT | 4116 |
| LbCas12a_NNK_95 | AAAAAGAAAACAAAGAGCTGNNKAACCTGGAAATCAATCTGCG | 4117 |
| LbCas12a_NNK_96 | AAGAAAACAAAGAGCTGGAANNKCTGGAAATCAATCTGCGTAA | 4118 |
| LbCas12a_NNK_97 | AAAACAAAGAGCTGGAAAACNNKGAAATCAATCTGCGTAAAGA | 4119 |
| LbCas12a_NNK_98 | ACAAAGAGCTGGAAAACCTGNNKATCAATCTGCGTAAAGAAAT | 4120 |
| LbCas12a_NNK_99 | AAGAGCTGGAAAACCTGGAANNKAATCTGCGTAAAGAAATCGC | 4121 |
| LbCas12a_NNK_100 | AGCTGGAAAACCTGGAAATCNNKCTGCGTAAAGAAATCGCCAA | 4122 |
| LbCas12a_NNK_101 | TGGAAAACCTGGAAATCAATNNKCGTAAAGAAATCGCCAAAGC | 4123 |
| LbCas12a_NNK_102 | AAAACCTGGAAATCAATCTGNNKAAAGAAATCGCCAAAGCGTT | 4124 |
| LbCas12a_NNK_103 | ACCTGGAAATCAATCTGCGTNNKGAAATCGCCAAAGCGTTTAA | 4125 |
| LbCas12a_NNK_104 | TGGAAATCAATCTGCGTAAANNKATCGCCAAAGCGTTTAAAGG | 4126 |
| LbCas12a_NNK_105 | AAATCAATCTGCGTAAAGAANNKGCCAAAGCGTTTAAAGGTAA | 4127 |
| LbCas12a_NNK_106 | TCAATCTGCGTAAAGAAATCNNKAAAGCGTTTAAAGGTAACGA | 4128 |
| LbCas12a_NNK_107 | ATCTGCGTAAAGAAATCGCCNNKGCGTTTAAAGGTAACGAGGG | 4129 |
| LbCas12a_NNK_108 | TGCGTAAAGAAATCGCCAAANNKTTTAAAGGTAACGAGGGTTA | 4130 |
| LbCas12a_NNK_109 | GTAAAGAAATCGCCAAAGCGNNKAAAGGTAACGAGGGTTATAA | 4131 |
| LbCas12a_NNK_110 | AAGAAATCGCCAAAGCGTTTNNKGGTAACGAGGGTTATAAAAG | 4132 |
| LbCas12a_NNK_111 | AAATCGCCAAAGCGTTTAAANNKAACGAGGGTTATAAAAGCCT | 4133 |
| LbCas12a_NNK_112 | TCGCCAAAGCGTTTAAAGGTNNKGAGGGTTATAAAAGCCTGTT | 4134 |
| LbCas12a_NNK_113 | CCAAAGCGTTTAAAGGTAACNNKGGTTATAAAAGCCTGTTCAA | 4135 |
| LbCas12a_NNK_114 | AAGCGTTTAAAGGTAACGAGNNKTATAAAAGCCTGTTCAAGAA | 4136 |
| LbCas12a_NNK_115 | CGTTTAAAGGTAACGAGGGTNNKAAAAGCCTGTTCAAGAAAGA | 4137 |
| LbCas12a_NNK_116 | TTAAAGGTAACGAGGGTTATNNKAGCCTGTTCAAGAAAGACAT | 4138 |
| LbCas12a_NNK_117 | AAGGTAACGAGGGTTATAAANNKCTGTTCAAGAAAGACATCAT | 4139 |
| LbCas12a_NNK_118 | GTAACGAGGGTTATAAAAGCNNKTTCAAGAAAGACATCATCGA | 4140 |
| LbCas12a_NNK_119 | ACGAGGGTTATAAAAGCCTGNNKAAGAAAGACATCATCGAAAC | 4141 |
| LbCas12a_NNK_120 | AGGGTTATAAAAGCCTGTTCNNKAAAGACATCATCGAAACCAT | 4142 |
| LbCas12a_NNK_121 | GTTATAAAAGCCTGTTCAAGNNKGACATCATCGAAACCATTCT | 4143 |
| LbCas12a_NNK_122 | ATAAAAGCCTGTTCAAGAAANNKATCATCGAAACCATTCTGCC | 4144 |
| LbCas12a_NNK_123 | AAAGCCTGTTCAAGAAAGACNNKATCGAAACCATTCTGCCGGA | 4145 |
| LbCas12a_NNK_124 | GCCTGTTCAAGAAAGACATCNNKGAAACCATTCTGCCGGAATT | 4146 |

TABLE 3-continued

Primers for creating LbCas12a Saturation Mutagenesis Library

| Name | Sequence (5'→3') | SEQ ID NO |
|---|---|---|
| LbCas12a_NNK_125 | TGTTCAAGAAAGACATCATCNNKACCATTCTGCCGGAATTTCT | 4147 |
| LbCas12a_NNK_126 | TCAAGAAAGACATCATCGAANNKATTCTGCCGGAATTTCTGGA | 4148 |
| LbCas12a_NNK_127 | AGAAAGACATCATCGAAACCNNKCTGCCGGAATTTCTGGATGA | 4149 |
| LbCas12a_NNK_128 | AAGACATCATCGAAACCATTNNKCCGGAATTTCTGGATGATAA | 4150 |
| LbCas12a_NNK_129 | ACATCATCGAAACCATTCTGNNKGAATTTCTGGATGATAAAGA | 4151 |
| LbCas12a_NNK_130 | TCATCGAAACCATTCTGCCGNNKTTTCTGGATGATAAAGATGA | 4152 |
| LbCas12a_NNK_131 | TCGAAACCATTCTGCCGGAANNKCTGGATGATAAAGATGAAAT | 4153 |
| LbCas12a_NNK_132 | AAACCATTCTGCCGGAATTTNNKGATGATAAAGATGAAATTGC | 4154 |
| LbCas12a_NNK_133 | CCATTCTGCCGGAATTTCTGNNKGATAAAGATGAAATTGCCCT | 4155 |
| LbCas12a_NNK_134 | TTCTGCCGGAATTTCTGGATNNKAAAGATGAAATTGCCCTGGT | 4156 |
| LbCas12a_NNK_135 | TGCCGGAATTTCTGGATGATNNKGATGAAATTGCCCTGGTGAA | 4157 |
| LbCas12a_NNK_136 | CGGAATTTCTGGATGATAAANNKGAAATTGCCCTGGTGAATAG | 4158 |
| LbCas12a_NNK_137 | AATTTCTGGATGATAAAGATNNKATTGCCCTGGTGAATAGCTT | 4159 |
| LbCas12a_NNK_138 | TTCTGGATGATAAAGATGAANNKGCCCTGGTGAATAGCTTTAA | 4160 |
| LbCas12a_NNK_139 | TGGATGATAAAGATGAAATTNNKCTGGTGAATAGCTTTAATGG | 4161 |
| LbCas12a_NNK_140 | ATGATAAAGATGAAATTGCCNNKGTGAATAGCTTTAATGGCTT | 4162 |
| LbCas12a_NNK_141 | ATAAAGATGAAATTGCCCTGNNKAATAGCTTTAATGGCTTTAC | 4163 |
| LbCas12a_NNK_142 | AAGATGAAATTGCCCTGGTGNNKAGCTTTAATGGCTTTACCAC | 4164 |
| LbCas12a_NNK_143 | ATGAAATTGCCCTGGTGAATNNKTTTAATGGCTTTACCACCGC | 4165 |
| LbCas12a_NNK_144 | AAATTGCCCTGGTGAATAGCNNKAATGGCTTTACCACCGCATT | 4166 |
| LbCas12a_NNK_145 | TTGCCCTGGTGAATAGCTTTNNKGGCTTTACCACCGCATTTAC | 4167 |
| LbCas12a_NNK_146 | CCCTGGTGAATAGCTTTAATNNKTTTACCACCGCATTTACCGG | 4168 |
| LbCas12a_NNK_147 | TGGTGAATAGCTTTAATGGCNNKACCACCGCATTTACCGGCTT | 4169 |
| LbCas12a_NNK_148 | TGAATAGCTTTAATGGCTTTNNKACCGCATTTACCGGCTTTTT | 4170 |
| LbCas12a_NNK_149 | ATAGCTTTAATGGCTTTACCNNKGCATTTACCGGCTTTTTTGA | 4171 |
| LbCas12a_NNK_150 | GCTTTAATGGCTTTACCACCNNKTTTACCGGCTTTTTTGATAA | 4172 |
| LbCas12a_NNK_151 | TTAATGGCTTTACCACCGCANNKACCGGCTTTTTTGATAATCG | 4173 |
| LbCas12a_NNK_152 | ATGGCTTTACCACCGCATTTNNKGGCTTTTTTGATAATCGCGA | 4174 |
| LbCas12a_NNK_153 | GCTTTACCACCGCATTTACCNNKTTTTTTGATAATCGCGAAAA | 4175 |
| LbCas12a_NNK_154 | TTACCACCGCATTTACCGGCNNKTTTGATAATCGCGAAAACAT | 4176 |
| LbCas12a_NNK_155 | CCACCGCATTTACCGGCTTTNNKGATAATCGCGAAAACATGTT | 4177 |
| LbCas12a_NNK_156 | CCGCATTTACCGGCTTTTTTNNKAATCGCGAAAACATGTTCAG | 4178 |
| LbCas12a_NNK_157 | CATTTACCGGCTTTTTTGATNNKCGCGAAAACATGTTCAGCGA | 4179 |
| LbCas12a_NNK_158 | TTACCGGCTTTTTTGATAATNNKGAAAACATGTTCAGCGAAGA | 4180 |
| LbCas12a_NNK_159 | CCGGCTTTTTTGATAATCGCNNKAACATGTTCAGCGAAGAAGC | 4181 |
| LbCas12a_NNK_160 | GCTTTTTTGATAATCGCGAANNKATGTTCAGCGAAGAAGCAAA | 4182 |
| LbCas12a_NNK_161 | TTTTTGATAATCGCGAAAACNNKTTCAGCGAAGAAGCAAAAAG | 4183 |
| LbCas12a_NNK_162 | TTGATAATCGCGAAAACATGNNKAGCGAAGAAGCAAAAAGCAC | 4184 |

TABLE 3-continued

Primers for creating LbCas12a Saturation Mutagenesis Library

| Name | Sequence (5'→3') | SEQ ID NO |
|---|---|---|
| LbCas12a_NNK_163 | ATAATCGCGAAAACATGTTCNNKGAAGAAGCAAAAAGCACCAG | 4185 |
| LbCas12a_NNK_164 | ATCGCGAAAACATGTTCAGCNNKGAAGCAAAAAGCACCAGCAT | 4186 |
| LbCas12a_NNK_165 | GCGAAAACATGTTCAGCGAANNKGCAAAAAGCACCAGCATTGC | 4187 |
| LbCas12a_NNK_166 | AAAACATGTTCAGCGAAGAANNKAAAAGCACCAGCATTGCATT | 4188 |
| LbCas12a_NNK_167 | ACATGTTCAGCGAAGAAGCANNKAGCACCAGCATTGCATTTCG | 4189 |
| LbCas12a_NNK_168 | TGTTCAGCGAAGAAGCAAAANNKACCAGCATTGCATTTCGCTG | 4190 |
| LbCas12a_NNK_169 | TCAGCGAAGAAGCAAAAAGCNNKAGCATTGCATTTCGCTGCAT | 4191 |
| LbCas12a_NNK_170 | GCGAAGAAGCAAAAAGCACCNNKATTGCATTTCGCTGCATTAA | 4192 |
| LbCas12a_NNK_171 | AAGAAGCAAAAAGCACCAGCNNKGCATTTCGCTGCATTAATGA | 4193 |
| LbCas12a_NNK_172 | AAGCAAAAAGCACCAGCATTNNKTTTCGCTGCATTAATGAAAA | 4194 |
| LbCas12a_NNK_173 | CAAAAAGCACCAGCATTGCANNKCGCTGCATTAATGAAAATCT | 4195 |
| LbCas12a_NNK_174 | AAAGCACCAGCATTGCATTTNNKTGCATTAATGAAAATCTGAC | 4196 |
| LbCas12a_NNK_175 | GCACCAGCATTGCATTTCGCNNKATTAATGAAAATCTGACCCG | 4197 |
| LbCas12a_NNK_176 | CCAGCATTGCATTTCGCTGCNNKAATGAAAATCTGACCCGCTA | 4198 |
| LbCas12a_NNK_177 | GCATTGCATTTCGCTGCATTNNKGAAAATCTGACCCGCTACAT | 4199 |
| LbCas12a_NNK_178 | TTGCATTTCGCTGCATTAATNNKAATCTGACCCGCTACATTAG | 4200 |
| LbCas12a_NNK_179 | CATTTCGCTGCATTAATGAANNKCTGACCCGCTACATTAGCAA | 4201 |
| LbCas12a_NNK_180 | TTCGCTGCATTAATGAAAATNNKACCCGCTACATTAGCAACAT | 4202 |
| LbCas12a_NNK_181 | GCTGCATTAATGAAAATCTGNNKCGCTACATTAGCAACATGGA | 4203 |
| LbCas12a_NNK_182 | GCATTAATGAAAATCTGACCNNKTACATTAGCAACATGGATAT | 4204 |
| LbCas12a_NNK_183 | TTAATGAAAATCTGACCCGCNNKATTAGCAACATGGATATCTT | 4205 |
| LbCas12a_NNK_184 | ATGAAAATCTGACCCGCTACNNKAGCAACATGGATATCTTTGA | 4206 |
| LbCas12a_NNK_185 | AAAATCTGACCCGCTACATTNNKAACATGGATATCTTTGAAAA | 4207 |
| LbCas12a_NNK_186 | ATCTGACCCGCTACATTAGCNNKATGGATATCTTTGAAAAGT | 4208 |
| LbCas12a_NNK_187 | TGACCCGCTACATTAGCAACNNKGATATCTTTGAAAAGTGGA | 4209 |
| LbCas12a_NNK_188 | ccCGCTACATTAGCAACATGNNKATCTTTGAAAAGTGGACGC | 4210 |
| LbCas12a_NNK_189 | GCTACATTAGCAACATGGATNNKTTTGAAAAGTGGACGCGAT | 4211 |
| LbCas12a_NNK_190 | ACATTAGCAACATGGATATCNNKGAAAAAGTGGACGCGATCTT | 4212 |
| LbCas12a_NNK_191 | TTAGCAACATGGATATCTTTNNKAAAGTGGACGCGATCTTCGA | 4213 |
| LbCas12a_NNK_192 | GCAACATGGATATCTTTGAANNKGTGGACGCGATCTTCGATAA | 4214 |
| LbCas12a_NNK_193 | ACATGGATATCTTTGAAAAANNKGACGCGATCTTCGATAAACA | 4215 |
| LbCas12a_NNK_194 | TGGATATCTTTGAAAAAGTGNNKGCGATCTTCGATAAACACGA | 4216 |
| LbCas12a_NNK_195 | ATATCTTTGAAAAAGTGGACNNKATCTTCGATAAACACGAAGT | 4217 |
| LbCas12a_NNK_196 | TCTTTGAAAAAGTGGACGCGNNKTTCGATAAACACGAAGTGCA | 4218 |
| LbCas12a_NNK_197 | TTGAAAAAGTGGACGCGATCNNKGATAAACACGAAGTGCAAGA | 4219 |
| LbCas12a_NNK_198 | AAAAGTGGACGCGATCTTCNNKAAACACGAAGTGCAAGAGAT | 4220 |
| LbCas12a_NNK_199 | AAGTGGACGCGATCTTCGATNNKCACGAAGTGCAAGAGATCAA | 4221 |

TABLE 3-continued

Primers for creating LbCas12a Saturation Mutagenesis Library

| Name | Sequence (5'→3') | SEQ ID NO |
|---|---|---|
| LbCas12a_NNK_200 | TGGACGCGATCTTCGATAAANNKGAAGTGCAAGAGATCAAAGA | 4222 |
| LbCas12a_NNK_201 | ACGCGATCTTCGATAAACACNNKGTGCAAGAGATCAAAGAGAA | 4223 |
| LbCas12a_NNK_202 | CGATCTTCGATAAACACGAANNKCAAGAGATCAAAGAGAAAAT | 4224 |
| LbCas12a_NNK_203 | TCTTCGATAAACACGAAGTGNNKGAGATCAAAGAGAAAATCCT | 4225 |
| LbCas12a_NNK_204 | TCGATAAACACGAAGTGCAANNKATCAAAGAGAAAATCCTGAA | 4226 |
| LbCas12a_NNK_205 | ATAAACACGAAGTGCAAGAGNNKAAAGAGAAAATCCTGAACAG | 4227 |
| LbCas12a_NNK_206 | AACACGAAGTGCAAGAGATCNNKGAGAAAATCCTGAACAGCGA | 4228 |
| LbCas12a_NNK_207 | ACGAAGTGCAAGAGATCAAANNKAAAATCCTGAACAGCGATTA | 4229 |
| LbCas12a_NNK_208 | AAGTGCAAGAGATCAAAGAGNNKATCCTGAACAGCGATTATGA | 4230 |
| LbCas12a_NNK_209 | TGCAAGAGATCAAAGAGAAANNKCTGAACAGCGATTATGACGT | 4231 |
| LbCas12a_NNK_210 | AAGAGATCAAAGAGAAAATCNNKAACAGCGATTATGACGTCGA | 4232 |
| LbCas12a_NNK_211 | AGATCAAAGAGAAAATCCTGNNKAGCGATTATGACGTCGAAGA | 4233 |
| LbCas12a_NNK_212 | TCAAAGAGAAAATCCTGAACNNKGATTATGACGTCGAAGATTT | 4234 |
| LbCas12a_NNK_213 | AAGAGAAAATCCTGAACAGCNNKTATGACGTCGAAGATTTTTT | 4235 |
| LbCas12a_NNK_214 | AGAAAATCCTGAACAGCGATNNKGACGTCGAAGATTTTTTTGA | 4236 |
| LbCas12a_NNK_215 | AAATCCTGAACAGCGATTATNNKGTCGAAGATTTTTTTGAAGG | 4237 |
| LbCas12a_NNK_216 | TCCTGAACAGCGATTATGACNNKGAAGATTTTTTTGAAGGCGA | 4238 |
| LbCas12a_NNK_217 | TGAACAGCGATTATGACGTCNNKGATTTTTTTGAAGGCGAGTT | 4239 |
| LbCas12a_NNK_218 | ACAGCGATTATGACGTCGAANNKTTTTTTGAAGGCGAGTTCTT | 4240 |
| LbCas12a_NNK_219 | GCGATTATGACGTCGAAGATNNKTTTGAAGGCGAGTTCTTTAA | 4241 |
| LbCas12a_NNK_220 | ATTATGACGTCGAAGATTTTNNKGAAGGCGAGTTCTTTAACTT | 4242 |
| LbCas12a_NNK_221 | ATGACGTCGAAGATTTTTTNNKGGCGAGTTCTTTAACTTCGT | 4243 |
| LbCas12a_NNK_222 | ACGTCGAAGATTTTTTTGAANNKGAGTTCTTTAACTTCGTTCT | 4244 |
| LbCas12a_NNK_223 | TCGAAGATTTTTTTGAAGGCNNKTTCTTTAACTTCGTTCTGAC | 4245 |
| LbCas12a_NNK_224 | AAGATTTTTTTGAAGGCGAGNNKTTTAACTTCGTTCTGACCCA | 4246 |
| LbCas12a_NNK_225 | ATTTTTTTGAAGGCGAGTTCNNKAACTTCGTTCTGACCCAAGA | 4247 |
| LbCas12a_NNK_226 | TTTTTGAAGGCGAGTTCTTTNNKTTCGTTCTGACCCAAGAAGG | 4248 |
| LbCas12a_NNK_227 | TTGAAGGCGAGTTCTTTAACNNKGTTCTGACCCAAGAAGGTAT | 4249 |
| LbCas12a_NNK_228 | AAGGCGAGTTCTTTAACTTCNNKCTGACCCAAGAAGGTATCGA | 4250 |
| LbCas12a_NNK_229 | GCGAGTTCTTTAACTTCGTTNNKACCCAAGAAGGTATCGACGT | 4251 |
| LbCas12a_NNK_230 | AGTTCTTTAACTTCGTTCTGNNKCAAGAAGGTATCGACGTTTA | 4252 |
| LbCas12a_NNK_231 | TCTTTAACTTCGTTCTGACCNNKGAAGGTATCGACGTTTATAA | 4253 |
| LbCas12a_NNK_232 | TTAACTTCGTTCTGACCCAANNKGGTATCGACGTTTATAACGC | 4254 |
| LbCas12a_NNK_233 | ACTTCGTTCTGACCCAAGAANNKATCGACGTTTATAACGCAAT | 4255 |
| LbCas12a_NNK_234 | TCGTTCTGACCCAAGAAGGTNNKGACGTTTATAACGCAATTAT | 4256 |
| LbCas12a_NNK_235 | TTCTGACCCAAGAAGGTATCNNKGTTTATAACGCAATTATTGG | 4257 |
| LbCas12a_NNK_236 | TGACCCAAGAAGGTATCGACNNKTATAACGCAATTATTGGTGG | 4258 |
| LbCas12a_NNK_237 | CCCAAGAAGGTATCGACGTTNNKAACGCAATTATTGGTGGTTT | 4259 |

TABLE 3-continued

Primers for creating LbCas12a Saturation Mutagenesis Library

| Name | Sequence (5'→3') | SEQ ID NO |
|---|---|---|
| LbCas12a_NNK_238 | AAGAAGGTATCGACGTTTATNNKGCAATTATTGGTGGTTTTGT | 4260 |
| LbCas12a_NNK_239 | AAGGTATCGACGTTTATAACNNKATTATTGGTGGTTTTGTTAC | 4261 |
| LbCas12a_NNK_240 | GTATCGACGTTTATAACGCANNKATTGGTGGTTTTGTTACCGA | 4262 |
| LbCas12a_NNK_241 | TCGACGTTTATAACGCAATTNNKGGTGGTTTTGTTACCGAAAG | 4263 |
| LbCas12a_NNK_242 | ACGTTTATAACGCAATTATTNNKGGTTTTGTTACCGAAAGCGG | 4264 |
| LbCas12a_NNK_243 | TTTATAACGCAATTATTGGTNNKTTTGTTACCGAAAGCGGTGA | 4265 |
| LbCas12a_NNK_244 | ATAACGCAATTATTGGTGGTNNKGTTACCGAAAGCGGTGAGAA | 4266 |
| LbCas12a_NNK_245 | ACGCAATTATTGGTGGTTTTNNKACCGAAAGCGGTGAGAAAAT | 4267 |
| LbCas12a_NNK_246 | CAATTATTGGTGGTTTTGTTNNKGAAAGCGGTGAGAAAATCAA | 4268 |
| LbCas12a_NNK_247 | TTATTGGTGGTTTTGTTACCNNKAGCGGTGAGAAAATCAAAGG | 4269 |
| LbCas12a_NNK_248 | TTGGTGGTTTTGTTACCGAANNKGGTGAGAAAATCAAAGGCCT | 4270 |
| LbCas12a_NNK_249 | GTGGTTTTGTTACCGAAAGCNNKGAGAAAATCAAAGGCCTGAA | 4271 |
| LbCas12a_NNK_250 | GTTTTGTTACCGAAAGCGGTNNKAAAATCAAAGGCCTGAATGA | 4272 |
| LbCas12a_NNK_251 | TTGTTACCGAAAGCGGTGAGNNKATCAAAGGCCTGAATGAATA | 4273 |
| LbCas12a_NNK_252 | TTACCGAAAGCGGTGAGAAANNKAAAGGCCTGAATGAATATAT | 4274 |
| LbCas12a_NNK_253 | CCGAAAGCGGTGAGAAAATCNNKGGCCTGAATGAATATATCAA | 4275 |
| LbCas12a_NNK_254 | AAAGCGGTGAGAAAATCAAANNKCTGAATGAATATATCAACCT | 4276 |
| LbCas12a_NNK_255 | GCGGTGAGAAAATCAAAGGCNNKAATGAATATATCAACCTGTA | 4277 |
| LbCas12a_NNK_256 | GTGAGAAAATCAAAGGCCTGNNKGAATATATCAACCTGTATAA | 4278 |
| LbCas12a_NNK_257 | AGAAAATCAAAGGCCTGAATNNKTATATCAACCTGTATAACCA | 4279 |
| LbCas12a_NNK_258 | AAATCAAAGGCCTGAATGAANNKATCAACCTGTATAACCAGAA | 4280 |
| LbCas12a_NNK_259 | TCAAAGGCCTGAATGAATATNNKAACCTGTATAACCAGAAAAC | 4281 |
| LbCas12a_NNK_260 | AAGGCCTGAATGAATATATCNNKCTGTATAACCAGAAAACCAA | 4282 |
| LbCas12a_NNK_261 | GCCTGAATGAATATATCAACNNKTATAACCAGAAAACCAAACA | 4283 |
| LbCas12a_NNK_262 | TGAATGAATATATCAACCTGNNKAACCAGAAAACCAAACAGAA | 4284 |
| LbCas12a_NNK_263 | ATGAATATATCAACCTGTATNNKCAGAAAACCAAACAGAAACT | 4285 |
| LbCas12a_NNK_264 | AATATATCAACCTGTATAACNNKAAAACCAAACAGAAACTGCC | 4286 |
| LbCas12a_NNK_265 | ATATCAACCTGTATAACCAGNNKACCAAACAGAAACTGCCGAA | 4287 |
| LbCas12a_NNK_266 | TCAACCTGTATAACCAGAAANNKAAACAGAAACTGCCGAAATT | 4288 |
| LbCas12a_NNK_267 | ACCTGTATAACCAGAAAACCNNKCAGAAACTGCCGAAATTCAA | 4289 |
| LbCas12a_NNK_268 | TGTATAACCAGAAAACCAAANNKAAACTGCCGAAATTCAAACC | 4290 |
| LbCas12a_NNK_269 | ATAACCAGAAAACCAAACAGNNKCTGCCGAAATTCAAACCGCT | 4291 |
| LbCas12a_NNK_270 | ACCAGAAAACCAAACAGAAANNKCCGAAATTCAAACCGCTGTA | 4292 |
| LbCas12a_NNK_271 | AGAAAACCAAACAGAAACTGNNKAAATTCAAACCGCTGTATAA | 4293 |
| LbCas12a_NNK_272 | AAACCAAACAGAAACTGCCGNNKTTCAAACCGCTGTATAAACA | 4294 |
| LbCas12a_NNK_273 | CCAAACAGAAACTGCCGAAANNKAAACCGCTGTATAAACAGGT | 4295 |
| LbCas12a_NNK_274 | AACAGAAACTGCCGAAATTCNNKCCGCTGTATAAACAGGTTCT | 4296 |

TABLE 3-continued

Primers for creating LbCas12a Saturation Mutagenesis Library

| Name | Sequence (5'→3') | SEQ ID NO |
|---|---|---|
| LbCas12a_NNK_275 | AGAAACTGCCGAAATTCAAANNKCTGTATAAACAGGTTCTGAG | 4297 |
| LbCas12a_NNK_276 | AACTGCCGAAATTCAAACCGNNKTATAAACAGGTTCTGAGCGA | 4298 |
| LbCas12a_NNK_277 | TGCCGAAATTCAAACCGCTGNNKAAACAGGTTCTGAGCGATCG | 4299 |
| LbCas12a_NNK_278 | CGAAATTCAAACCGCTGTATNNKCAGGTTCTGAGCGATCGTGA | 4300 |
| LbCas12a_NNK_279 | AATTCAAACCGCTGTATAAANNKGTTCTGAGCGATCGTGAAAG | 4301 |
| LbCas12a_NNK_280 | TCAAACCGCTGTATAAACAGNNKCTGAGCGATCGTGAAAGCCT | 4302 |
| LbCas12a_NNK_281 | AACCGCTGTATAAACAGGTTNNKAGCGATCGTGAAAGCCTGAG | 4303 |
| LbCas12a_NNK_282 | CGCTGTATAAACAGGTTCTGNNKGATCGTGAAAGCCTGAGCTT | 4304 |
| LbCas12a_NNK_283 | TGTATAAACAGGTTCTGAGCNNKCGTGAAAGCCTGAGCTTTTA | 4305 |
| LbCas12a_NNK_284 | ATAAACAGGTTCTGAGCGATNNKGAAAGCCTGAGCTTTTATGG | 4306 |
| LbCas12a_NNK_285 | AACAGGTTCTGAGCGATCGTNNKAGCCTGAGCTTTTATGGTGA | 4307 |
| LbCas12a_NNK_286 | AGGTTCTGAGCGATCGTGAANNKCTGAGCTTTTATGGTGAAGG | 4308 |
| LbCas12a_NNK_287 | TTCTGAGCGATCGTGAAAGCNNKAGCTTTTATGGTGAAGGTTA | 4309 |
| LbCas12a_NNK_288 | TGAGCGATCGTGAAAGCCTGNNKTTTTATGGTGAAGGTTATAC | 4310 |
| LbCas12a_NNK_289 | GCGATCGTGAAAGCCTGAGCNNKTATGGTGAAGGTTATACCAG | 4311 |
| LbCas12a_NNK_290 | ATCGTGAAAGCCTGAGCTTTNNKGGTGAAGGTTATACCAGTGA | 4312 |
| LbCas12a_NNK_291 | GTGAAAGCCTGAGCTTTTATNNKGAAGGTTATACCAGTGATGA | 4313 |
| LbCas12a_NNK_292 | AAAGCCTGAGCTTTTATGGTNNKGGTTATACCAGTGATGAAGA | 4314 |
| LbCas12a_NNK_293 | GCCTGAGCTTTTATGGTGAANNKTATACCAGTGATGAAGAGGT | 4315 |
| LbCas12a_NNK_294 | TGAGCTTTTATGGTGAAGGTNNKACCAGTGATGAAGAGGTTCT | 4316 |
| LbCas12a_NNK_295 | GCTTTTATGGTGAAGGTTATNNKAGTGATGAAGAGGTTCTGGA | 4317 |
| LbCas12a_NNK_296 | TTTATGGTGAAGGTTATACCNNKGATGAAGAGGTTCTGGAAGT | 4318 |
| LbCas12a_NNK_297 | ATGGTGAAGGTTATACCAGTNNKGAAGAGGTTCTGGAAGTTTT | 4319 |
| LbCas12a_NNK_298 | GTGAAGGTTATACCAGTGATNNKGAGGTTCTGGAAGTTTTTCG | 4320 |
| LbCas12a_NNK_299 | AAGGTTATACCAGTGATGAANNKGTTCTGGAAGTTTTTCGTAA | 4321 |
| LbCas12a_NNK_300 | GTTATACCAGTGATGAAGAGNNKCTGGAAGTTTTTCGTAACAC | 4322 |
| LbCas12a_NNK_301 | ATACCAGTGATGAAGAGGTTNNKGAAGTTTTTCGTAACACCCT | 4323 |
| LbCas12a_NNK_302 | CCAGTGATGAAGAGGTTCTGNNKGTTTTTCGTAACACCCTGAA | 4324 |
| LbCas12a_NNK_303 | GTGATGAAGAGGTTCTGGAANNKTTTCGTAACACCCTGAATAA | 4325 |
| LbCas12a_NNK_304 | ATGAAGAGGTTCTGGAAGTTNNKCGTAACACCCTGAATAAAAA | 4326 |
| LbCas12a_NNK_305 | AAGAGGTTCTGGAAGTTTTTNNKAACACCCTGAATAAAAACAG | 4327 |
| LbCas12a_NNK_306 | AGGTTCTGGAAGTTTTTCGTNNKACCCTGAATAAAAACAGCGA | 4328 |
| LbCas12a_NNK_307 | TTCTGGAAGTTTTTCGTAACNNKCTGAATAAAAACAGCGAGAT | 4329 |
| LbCas12a_NNK_308 | TGGAAGTTTTTCGTAACACCNNKAATAAAAACAGCGAGATCTT | 4330 |
| LbCas12a_NNK_309 | AAGTTTTTCGTAACACCCTGNNKAAAAACAGCGAGATCTTTAG | 4331 |
| LbCas12a_NNK_310 | TTTTTCGTAACACCCTGAATNNKAACAGCGAGATCTTTAGCAG | 4332 |
| LbCas12a_NNK_311 | TTCGTAACACCCTGAATAAANNKAGCGAGATCTTTAGCAGCAT | 4333 |
| LbCas12a_NNK_312 | GTAACACCCTGAATAAAAACNNKGAGATCTTTAGCAGCATCAA | 4334 |

TABLE 3-continued

Primers for creating LbCas12a Saturation Mutagenesis Library

| Name | Sequence (5'→3') | SEQ ID NO |
|---|---|---|
| LbCas12a_NNK_313 | ACACCCTGAATAAAAACAGCNNKATCTTTAGCAGCATCAAAAA | 4335 |
| LbCas12a_NNK_314 | CCCTGAATAAAAACAGCGAGNNKTTTAGCAGCATCAAAAAGCT | 4336 |
| LbCas12a_NNK_315 | TGAATAAAAACAGCGAGATCNNKAGCAGCATCAAAAAGCTTGA | 4337 |
| LbCas12a_NNK_316 | ATAAAAACAGCGAGATCTTTNNKAGCATCAAAAAGCTTGAGAA | 4338 |
| LbCas12a_NNK_317 | AAAACAGCGAGATCTTTAGCNNKATCAAAAAGCTTGAGAAACT | 4339 |
| LbCas12a_NNK_318 | ACAGCGAGATCTTTAGCAGCNNKAAAAAGCTTGAGAAACTGTT | 4340 |
| LbCas12a_NNK_319 | GCGAGATCTTTAGCAGCATCNNKAAGCTTGAGAAACTGTTCAA | 4341 |
| LbCas12a_NNK_320 | AGATCTTTAGCAGCATCAAANNKCTTGAGAAACTGTTCAAAAA | 4342 |
| LbCas12a_NNK_321 | TCTTTAGCAGCATCAAAAAGNNKGAGAAACTGTTCAAAAACTT | 4343 |
| LbCas12a_NNK_322 | TTAGCAGCATCAAAAAGCTTNNKAAACTGTTCAAAAACTTTGA | 4344 |
| LbCas12a_NNK_323 | GCAGCATCAAAAAGCTTGAGNNKCTGTTCAAAAACTTTGATGA | 4345 |
| LbCas12a_NNK_324 | GCATCAAAAAGCTTGAGAAANNKTTCAAAAACTTTGATGAGTA | 4346 |
| LbCas12a_NNK_325 | TCAAAAAGCTTGAGAAACTGNNKAAAAACTTTGATGAGTATAG | 4347 |
| LbCas12a_NNK_326 | AAAAGCTTGAGAAACTGTTCNNKAACTTTGATGAGTATAGCAG | 4348 |
| LbCas12a_NNK_327 | AGCTTGAGAAACTGTTCAAANNKTTTGATGAGTATAGCAGCGC | 4349 |
| LbCas12a_NNK_328 | TTGAGAAACTGTTCAAAAACNNKGATGAGTATAGCAGCGCAGG | 4350 |
| LbCas12a_NNK_329 | AGAAACTGTTCAAAAACTTTNNKGAGTATAGCAGCGCAGGCAT | 4351 |
| LbCas12a_NNK_330 | AACTGTTCAAAAACTTTGATNNKTATAGCAGCGCAGGCATCTT | 4352 |
| LbCas12a_NNK_331 | TGTTCAAAAACTTTGATGAGNNKAGCAGCGCAGGCATCTTTGT | 4353 |
| LbCas12a_NNK_332 | TCAAAAACTTTGATGAGTATNNKAGCGCAGGCATCTTTGTTAA | 4354 |
| LbCas12a_NNK_333 | AAAACTTTGATGAGTATAGCNNKGCAGGCATCTTTGTTAAAAA | 4355 |
| LbCas12a_NNK_334 | ACTTTGATGAGTATAGCAGCNNKGGCATCTTTGTTAAAAATGG | 4356 |
| LbCas12a_NNK_335 | TTGATGAGTATAGCAGCGCANNKATCTTTGTTAAAAATGGTCC | 4357 |
| LbCas12a_NNK_336 | ATGAGTATAGCAGCGCAGGCNNKTTTGTTAAAAATGGTCCGGC | 4358 |
| LbCas12a_NNK_337 | AGTATAGCAGCGCAGGCATCNNKGTTAAAAATGGTCCGGCAAT | 4359 |
| LbCas12a_NNK_338 | ATAGCAGCGCAGGCATCTTTNNKAAAAATGGTCCGGCAATTAG | 4360 |
| LbCas12a_NNK_339 | GCAGCGCAGGCATCTTTGTTNNKAATGGTCCGGCAATTAGCAC | 4361 |
| LbCas12a_NNK_340 | GCGCAGGCATCTTTGTTAAANNKGGTCCGGCAATTAGCACCAT | 4362 |
| LbCas12a_NNK_341 | CAGGCATCTTTGTTAAAAATNNKCCGGCAATTAGCACCATCAG | 4363 |
| LbCas12a_NNK_342 | GCATCTTTGTTAAAAATGGTNNKGCAATTAGCACCATCAGCAA | 4364 |
| LbCas12a_NNK_343 | TCTTTGTTAAAAATGGTCCGNNKATTAGCACCATCAGCAAAGA | 4365 |
| LbCas12a_NNK_344 | TTGTTAAAAATGGTCCGGCANNKAGCACCATCAGCAAAGATAT | 4366 |
| LbCas12a_NNK_345 | TTAAAAATGGTCCGGCAATTNNKACCATCAGCAAAGATATTTT | 4367 |
| LbCas12a_NNK_346 | AAAATGGTCCGGCAATTAGCNNKATCAGCAAAGATATTTTTGG | 4368 |
| LbCas12a_NNK_347 | ATGGTCCGGCAATTAGCACCNNKAGCAAAGATATTTTTGGCGA | 4369 |
| LbCas12a_NNK_348 | GTCCGGCAATTAGCACCATCNNKAAAGATATTTTTGGCGAATG | 4370 |
| LbCas12a_NNK_349 | CGGCAATTAGCACCATCAGCNNKGATATTTTTGGCGAATGGAA | 4371 |

TABLE 3-continued

Primers for creating LbCas12a Saturation Mutagenesis Library

| Name | Sequence (5'→3') | SEQ ID NO |
|---|---|---|
| LbCas12a_NNK_350 | CAATTAGCACCATCAGCAAANNKATTTTTGGCGAATGGAATGT | 4372 |
| LbCas12a_NNK_351 | TTAGCACCATCAGCAAAGATNNKTTTGGCGAATGGAATGTGAT | 4373 |
| LbCas12a_NNK_352 | GCACCATCAGCAAAGATATTNNKGGCGAATGGAATGTGATCCG | 4374 |
| LbCas12a_NNK_353 | CCATCAGCAAAGATATTTTTNNKGAATGGAATGTGATCCGCGA | 4375 |
| LbCas12a_NNK_354 | TCAGCAAAGATATTTTTGGCNNKTGGAATGTGATCCGCGATAA | 4376 |
| LbCas12a_NNK_355 | GCAAAGATATTTTTGGCGAANNKAATGTGATCCGCGATAAATG | 4377 |
| LbCas12a_NNK_356 | AAGATATTTTTGGCGAATGGNNKGTGATCCGCGATAAATGGAA | 4378 |
| LbCas12a_NNK_357 | ATATTTTTGGCGAATGGAATNNKATCCGCGATAAATGGAATGC | 4379 |
| LbCas12a_NNK_358 | TTTTTGGCGAATGGAATGTGNNKCGCGATAAATGGAATGCCGA | 4380 |
| LbCas12a_NNK_359 | TTGGCGAATGGAATGTGATCNNKGATAAATGGAATGCCGAATA | 4381 |
| LbCas12a_NNK_360 | GCGAATGGAATGTGATCCGCNNKAAATGGAATGCCGAATATGA | 4382 |
| LbCas12a_NNK_361 | AATGGAATGTGATCCGCGATNNKTGGAATGCCGAATATGATGA | 4383 |
| LbCas12a_NNK_362 | GGAATGTGATCCGCGATAAANNKAATGCCGAATATGATGATAT | 4384 |
| LbCas12a_NNK_363 | ATGTGATCCGCGATAAATGGNNKGCCGAATATGATGATATCCA | 4385 |
| LbCas12a_NNK_364 | TGATCCGCGATAAATGGAATNNKGAATATGATGATATCCACCT | 4386 |
| LbCas12a_NNK_365 | TCCGCGATAAATGGAATGCCNNKTATGATGATATCCACCTGAA | 4387 |
| LbCas12a_NNK_366 | GCGATAAATGGAATGCCGAANNKGATGATATCCACCTGAAAAA | 4388 |
| LbCas12a_NNK_367 | ATAAATGGAATGCCGAATATNNKGATATCCACCTGAAAAAAAA | 4389 |
| LbCas12a_NNK_368 | AATGGAATGCCGAATATGATNNKATCCACCTGAAAAAAAAGGC | 4390 |
| LbCas12a_NNK_369 | GGAATGCCGAATATGATGATNNKCACCTGAAAAAAAAGGCCGT | 4391 |
| LbCas12a_NNK_370 | ATGCCGAATATGATGATATCNNKCTGAAAAAAAAGGCCGTGGT | 4392 |
| LbCas12a_NNK_371 | CCGAATATGATGATATCCACNNKAAAAAAAAGGCCGTGGTGAC | 4393 |
| LbCas12a_NNK_372 | AATATGATGATATCCACCTGNNKAAAAAGGCCGTGGTGACCGA | 4394 |
| LbCas12a_NNK_373 | ATGATGATATCCACCTGAAANNKAAGGCCGTGGTGACCGAGAA | 4395 |
| LbCas12a_NNK_374 | ATGATATCCACCTGAAAAAANNKGCCGTGGTGACCGAGAAATA | 4396 |
| LbCas12a_NNK_375 | ATATCCACCTGAAAAAAAAGNNKGTGGTGACCGAGAAATATGA | 4397 |
| LbCas12a_NNK_376 | TCCACCTGAAAAAAAAGGCCNNKGTGACCGAGAAATATGAAGA | 4398 |
| LbCas12a_NNK_377 | ACCTGAAAAAAAAGGCCGTGNNKACCGAGAAATATGAAGATGA | 4399 |
| LbCas12a_NNK_378 | TGAAAAAAAAGGCCGTGGTGNNKGAGAAATATGAAGATGATCG | 4400 |
| LbCas12a_NNK_379 | AAAAAAAGGCCGTGGTGACCNNKAAATATGAAGATGATCGTCG | 4401 |
| LbCas12a_NNK_380 | AAAAGGCCGTGGTGACCGAGNNKTATGAAGATGATCGTCGTAA | 4402 |
| LbCas12a_NNK_381 | AGGCCGTGGTGACCGAGAAANNKGAAGATGATCGTCGTAAAAG | 4403 |
| LbCas12a_NNK_382 | CCGTGGTGACCGAGAAATATNNKGATGATCGTCGTAAAAGCTT | 4404 |
| LbCas12a_NNK_383 | TGGTGACCGAGAAATATGAANNKGATCGTCGTAAAAGCTTCAA | 4405 |
| LbCas12a_NNK_384 | TGACCGAGAAATATGAAGATNNKCGTCGTAAAAGCTTCAAGAA | 4406 |
| LbCas12a_NNK_385 | CCGAGAAATATGAAGATGATNNKCGTAAAAGCTTCAAGAAAAT | 4407 |
| LbCas12a_NNK_386 | AGAAATATGAAGATGATCGTNNKAAAAGCTTCAAGAAAATTGG | 4408 |
| LbCas12a_NNK_387 | AATATGAAGATGATCGTCGTNNKAGCTTCAAGAAAATTGGTAG | 4409 |

TABLE 3-continued

Primers for creating LbCas12a Saturation Mutagenesis Library

| Name | Sequence (5'→3') | SEQ ID NO |
|---|---|---|
| LbCas12a_NNK_388 | ATGAAGATGATCGTCGTAAANNKTTCAAGAAAATTGGTAGCTT | 4410 |
| LbCas12a_NNK_389 | AAGATGATCGTCGTAAAAGCNNKAAGAAAATTGGTAGCTTTAG | 4411 |
| LbCas12a_NNK_390 | ATGATCGTCGTAAAAGCTTCNNKAAAATTGGTAGCTTTAGCCT | 4412 |
| LbCas12a_NNK_391 | ATCGTCGTAAAAGCTTCAAGNNKATTGGTAGCTTTAGCCTGGA | 4413 |
| LbCas12a_NNK_392 | GTCGTAAAAGCTTCAAGAAANNKGGTAGCTTTAGCCTGGAACA | 4414 |
| LbCas12a_NNK_393 | GTAAAAGCTTCAAGAAAATTNNKAGCTTTAGCCTGGAACAGCT | 4415 |
| LbCas12a_NNK_394 | AAAGCTTCAAGAAAATTGGTNNKTTTAGCCTGGAACAGCTGCA | 4416 |
| LbCas12a_NNK_395 | GCTTCAAGAAAATTGGTAGCNNKAGCCTGGAACAGCTGCAAGA | 4417 |
| LbCas12a_NNK_396 | TCAAGAAAATTGGTAGCTTTNNKCTGGAACAGCTGCAAGAATA | 4418 |
| LbCas12a_NNK_397 | AGAAAATTGGTAGCTTTAGCNNKGAACAGCTGCAAGAATATGC | 4419 |
| LbCas12a_NNK_398 | AAATTGGTAGCTTTAGCCTGNNKCAGCTGCAAGAATATGCAGA | 4420 |
| LbCas12a_NNK_399 | TTGGTAGCTTTAGCCTGGAANNKCTGCAAGAATATGCAGATGC | 4421 |
| LbCas12a_NNK_400 | GTAGCTTTAGCCTGGAACAGNNKCAAGAATATGCAGATGCAGA | 4422 |
| LbCas12a_NNK_401 | GCTTTAGCCTGGAACAGCTGNNKGAATATGCAGATGCAGATCT | 4423 |
| LbCas12a_NNK_402 | TTAGCCTGGAACAGCTGCAANNKTATGCAGATGCAGATCTGAG | 4424 |
| LbCas12a_NNK_403 | GCCTGGAACAGCTGCAAGAANNKGCAGATGCAGATCTGAGCGT | 4425 |
| LbCas12a_NNK_404 | TGGAACAGCTGCAAGAATATNNKGATGCAGATCTGAGCGTTGT | 4426 |
| LbCas12a_NNK_405 | AACAGCTGCAAGAATATGCANNKGCAGATCTGAGCGTTGTGGA | 4427 |
| LbCas12a_NNK_406 | AGCTGCAAGAATATGCAGATNNKGATCTGAGCGTTGTGGAAAA | 4428 |
| LbCas12a_NNK_407 | TGCAAGAATATGCAGATGCANNKCTGAGCGTTGTGGAAAAACT | 4429 |
| LbCas12a_NNK_408 | AAGAATATGCAGATGCAGATNNKAGCGTTGTGGAAAAACTGAA | 4430 |
| LbCas12a_NNK_409 | AATATGCAGATGCAGATCTGNNKGTTGTGGAAAAACTGAAAGA | 4431 |
| LbCas12a_NNK_410 | ATGCAGATGCAGATCTGAGCNNKGTGGAAAAACTGAAAGAAAT | 4432 |
| LbCas12a_NNK_411 | CAGATGCAGATCTGAGCGTTNNKGAAAAACTGAAAGAAATCAT | 4433 |
| LbCas12a_NNK_412 | ATGCAGATCTGAGCGTTGTGNNKAAACTGAAAGAAATCATCAT | 4434 |
| LbCas12a_NNK_413 | CAGATCTGAGCGTTGTGGAANNKCTGAAAGAAATCATCATTCA | 4435 |
| LbCas12a_NNK_414 | ATCTGAGCGTTGTGGAAAAANNKAAAGAAATCATCATTCAGAA | 4436 |
| LbCas12a_NNK_415 | TGAGCGTTGTGGAAAAACTGNNKGAAATCATCATTCAGAAGGT | 4437 |
| LbCas12a_NNK_416 | GCGTTGTGGAAAAACTGAAANNKATCATCATTCAGAAGGTGGA | 4438 |
| LbCas12a_NNK_417 | TTGTGGAAAAACTGAAAGAANNKATCATTCAGAAGGTGGACGA | 4439 |
| LbCas12a_NNK_418 | TGGAAAAACTGAAAGAAATCNNKATTCAGAAGGTGGACGAGAT | 4440 |
| LbCas12a_NNK_419 | AAAAACTGAAAGAAATCATCNNKCAGAAGGTGGACGAGATCTA | 4441 |
| LbCas12a_NNK_420 | AACTGAAAGAAATCATCATTNNKAAGGTGGACGAGATCTATAA | 4442 |
| LbCas12a_NNK_421 | TGAAAGAAATCATCATTCAGNNKGTGGACGAGATCTATAAAGT | 4443 |
| LbCas12a_NNK_422 | AAGAAATCATCATTCAGAAGNNKGACGAGATCTATAAAGTTTA | 4444 |
| LbCas12a_NNK_423 | AAATCATCATTCAGAAGGTGNNKGAGATCTATAAAGTTTATGG | 4445 |
| LbCas12a_NNK_424 | TCATCATTCAGAAGGTGGACNNKATCTATAAAGTTTATGGTAG | 4446 |

TABLE 3-continued

Primers for creating LbCas12a Saturation Mutagenesis Library

| Name | Sequence (5'→3') | SEQ ID NO |
|---|---|---|
| LbCas12a_NNK_425 | TCATTCAGAAGGTGGACGAGNNKTATAAAGTTTATGGTAGCAG | 4447 |
| LbCas12a_NNK_426 | TTCAGAAGGTGGACGAGATCNNKAAAGTTTATGGTAGCAGCGA | 4448 |
| LbCas12a_NNK_427 | AGAAGGTGGACGAGATCTATNNKGTTTATGGTAGCAGCGAAAA | 4449 |
| LbCas12a_NNK_428 | AGGTGGACGAGATCTATAAANNKTATGGTAGCAGCGAAAAACT | 4450 |
| LbCas12a_NNK_429 | TGGACGAGATCTATAAAGTTNNKGGTAGCAGCGAAAAACTGTT | 4451 |
| LbCas12a_NNK_430 | ACGAGATCTATAAAGTTTATNNKAGCAGCGAAAAACTGTTCGA | 4452 |
| LbCas12a_NNK_431 | AGATCTATAAAGTTTATGGTNNKAGCGAAAAACTGTTCGATGC | 4453 |
| LbCas12a_NNK_432 | TCTATAAAGTTTATGGTAGCNNKGAAAAACTGTTCGATGCAGA | 4454 |
| LbCas12a_NNK_433 | ATAAAGTTTATGGTAGCAGCNNKAAACTGTTCGATGCAGATTT | 4455 |
| LbCas12a_NNK_434 | AAGTTTATGGTAGCAGCGAANNKCTGTTCGATGCAGATTTTGT | 4456 |
| LbCas12a_NNK_435 | TTTATGGTAGCAGCGAAAAANNKTTCGATGCAGATTTTGTTCT | 4457 |
| LbCas12a_NNK_436 | ATGGTAGCAGCGAAAAACTGNNKGATGCAGATTTTGTTCTGGA | 4458 |
| LbCas12a_NNK_437 | GTAGCAGCGAAAAACTGTTCNNKGCAGATTTTGTTCTGGAAAA | 4459 |
| LbCas12a_NNK_438 | GCAGCGAAAAACTGTTCGATNNKGATTTTGTTCTGGAAAAAAG | 4460 |
| LbCas12a_NNK_439 | GCGAAAAACTGTTCGATGCANNKTTTGTTCTGGAAAAAAGCCT | 4461 |
| LbCas12a_NNK_440 | AAAAACTGTTCGATGCAGATNNKGTTCTGGAAAAAAGCCTGAA | 4462 |
| LbCas12a_NNK_441 | AACTGTTCGATGCAGATTTTNNKCTGGAAAAAAGCCTGAAAAA | 4463 |
| LbCas12a_NNK_442 | TGTTCGATGCAGATTTTGTTNNKGAAAAAAGCCTGAAAAAGAA | 4464 |
| LbCas12a_NNK_443 | TCGATGCAGATTTTGTTCTGNNKAAAAGCCTGAAAAAGAATGA | 4465 |
| LbCas12a_NNK_444 | ATGCAGATTTTGTTCTGGAANNKAGCCTGAAAAAGAATGATGC | 4466 |
| LbCas12a_NNK_445 | CAGATTTTGTTCTGGAAAAANNKCTGAAAAAGAATGATGCCGT | 4467 |
| LbCas12a_NNK_446 | ATTTTGTTCTGGAAAAAAGCNNKAAAAAGAATGATGCCGTTGT | 4468 |
| LbCas12a_NNK_447 | TTGTTCTGGAAAAAAGCCTGNNKAAGAATGATGCCGTTGTGGC | 4469 |
| LbCas12a_NNK_448 | TTCTGGAAAAAAGCCTGAAANNKAATGATGCCGTTGTGGCCAT | 4470 |
| LbCas12a_NNK_449 | TGGAAAAAAGCCTGAAAAAGNNKGATGCCGTTGTGGCCATTAT | 4471 |
| LbCas12a_NNK_450 | AAAAAAGCCTGAAAAAGAATNNKGCCGTTGTGGCCATTATGAA | 4472 |
| LbCas12a_NNK_451 | AAAGCCTGAAAAAGAATGATNNKGTTGTGGCCATTATGAAAGA | 4473 |
| LbCas12a_NNK_452 | GCCTGAAAAAGAATGATGCCNNKGTGGCCATTATGAAAGATCT | 4474 |
| LbCas12a_NNK_453 | TGAAAAAGAATGATGCCGTTNNKGCCATTATGAAAGATCTGCT | 4475 |
| LbCas12a_NNK_454 | AAAAGAATGATGCCGTTGTGNNKATTATGAAAGATCTGCTGGA | 4476 |
| LbCas12a_NNK_455 | AGAATGATGCCGTTGTGGCCNNKATGAAAGATCTGCTGGATAG | 4477 |
| LbCas12a_NNK_456 | ATGATGCCGTTGTGGCCATTNNKAAAGATCTGCTGGATAGCGT | 4478 |
| LbCas12a_NNK_457 | ATGCCGTTGTGGCCATTATGNNKGATCTGCTGGATAGCGTTAA | 4479 |
| LbCas12a_NNK_458 | CCGTTGTGGCCATTATGAAANNKCTGCTGGATAGCGTTAAGAG | 4480 |
| LbCas12a_NNK_459 | TTGTGGCCATTATGAAAGATNNKCTGGATAGCGTTAAGAGCTT | 4481 |
| LbCas12a_NNK_460 | TGGCCATTATGAAAGATCTGNNKGATAGCGTTAAGAGCTTCGA | 4482 |
| LbCas12a_NNK_461 | CCATTATGAAAGATCTGCTGNNKAGCGTTAAGAGCTTCGAGAA | 4483 |
| LbCas12a_NNK_462 | TTATGAAAGATCTGCTGGATNNKGTTAAGAGCTTCGAGAATTA | 4484 |

TABLE 3-continued

Primers for creating LbCas12a Saturation Mutagenesis Library

| Name | Sequence (5'→3') | SEQ ID NO |
|---|---|---|
| LbCas12a_NNK_463 | TGAAAGATCTGCTGGATAGCNNKAAGAGCTTCGAGAATTACAT | 4485 |
| LbCas12a_NNK_464 | AAGATCTGCTGGATAGCGTTNNKAGCTTCGAGAATTACATCAA | 4486 |
| LbCas12a_NNK_465 | ATCTGCTGGATAGCGTTAAGNNKTTCGAGAATTACATCAAAGC | 4487 |
| LbCas12a_NNK_466 | TGCTGGATAGCGTTAAGAGCNNKGAGAATTACATCAAAGCCTT | 4488 |
| LbCas12a_NNK_467 | TGGATAGCGTTAAGAGCTTCNNKAATTACATCAAAGCCTTTTT | 4489 |
| LbCas12a_NNK_468 | ATAGCGTTAAGAGCTTCGAGNNKTACATCAAAGCCTTTTTTGG | 4490 |
| LbCas12a_NNK_469 | GCGTTAAGAGCTTCGAGAATNNKATCAAAGCCTTTTTTGGTGA | 4491 |
| LbCas12a_NNK_470 | TTAAGAGCTTCGAGAATTACNNKAAAGCCTTTTTTGGTGAGGG | 4492 |
| LbCas12a_NNK_471 | AGAGCTTCGAGAATTACATCNNKGCCTTTTTTGGTGAGGGCAA | 4493 |
| LbCas12a_NNK_472 | GCTTCGAGAATTACATCAAANNKTTTTTTGGTGAGGGCAAAGA | 4494 |
| LbCas12a_NNK_473 | TCGAGAATTACATCAAAGCCNNKTTTGGTGAGGGCAAAGAAAC | 4495 |
| LbCas12a_NNK_474 | AGAATTACATCAAAGCCTTTNNKGGTGAGGGCAAAGAAACCAA | 4496 |
| LbCas12a_NNK_475 | ATTACATCAAAGCCTTTTTTNNKGAGGGCAAAGAAACCAATCG | 4497 |
| LbCas12a_NNK_476 | ACATCAAAGCCTTTTTTGGTNNKGGCAAAGAAACCAATCGTGA | 4498 |
| LbCas12a_NNK_477 | TCAAAGCCTTTTTTGGTGAGNNKAAAGAAACCAATCGTGATGA | 4499 |
| LbCas12a_NNK_478 | AAGCCTTTTTTGGTGAGGGCNNKGAAACCAATCGTGATGAAAG | 4500 |
| LbCas12a_NNK_479 | CCTTTTTTGGTGAGGGCAAANNKACCAATCGTGATGAAAGTTT | 4501 |
| LbCas12a_NNK_480 | TTTTTGGTGAGGGCAAAGAANNKAATCGTGATGAAAGTTTCTA | 4502 |
| LbCas12a_NNK_481 | TTGGTGAGGGCAAAGAAACCNNKCGTGATGAAAGTTTCTATGG | 4503 |
| LbCas12a_NNK_482 | GTGAGGGCAAAGAAACCAATNNKGATGAAAGTTTCTATGGCGA | 4504 |
| LbCas12a_NNK_483 | AGGGCAAAGAAACCAATCGTNNKGAAAGTTTCTATGGCGATTT | 4505 |
| LbCas12a_NNK_484 | GCAAAGAAACCAATCGTGATNNKAGTTTCTATGGCGATTTTGT | 4506 |
| LbCas12a_NNK_485 | AAGAAACCAATCGTGATGAANNKTTCTATGGCGATTTTGTGCT | 4507 |
| LbCas12a_NNK_486 | AAACCAATCGTGATGAAAGTNNKTATGGCGATTTTGTGCTGGC | 4508 |
| LbCas12a_NNK_487 | CCAATCGTGATGAAAGTTTCNNKGGCGATTTTGTGCTGGCCTA | 4509 |
| LbCas12a_NNK_488 | ATCGTGATGAAAGTTTCTATNNKGATTTTGTGCTGGCCTATGA | 4510 |
| LbCas12a_NNK_489 | GTGATGAAAGTTTCTATGGCNNKTTTGTGCTGGCCTATGATAT | 4511 |
| LbCas12a_NNK_490 | ATGAAAGTTTCTATGGCGATNNKGTGCTGGCCTATGATATTCT | 4512 |
| LbCas12a_NNK_491 | AAAGTTTCTATGGCGATTTTNNKCTGGCCTATGATATTCTGCT | 4513 |
| LbCas12a_NNK_492 | GTTTCTATGGCGATTTTGTGNNKGCCTATGATATTCTGCTGAA | 4514 |
| LbCas12a_NNK_493 | TCTATGGCGATTTTGTGCTGNNKTATGATATTCTGCTGAAAGT | 4515 |
| LbCas12a_NNK_494 | ATGGCGATTTTGTGCTGGCCNNKGATATTCTGCTGAAAGTGGA | 4516 |
| LbCas12a_NNK_495 | GCGATTTTGTGCTGGCCTATNNKATTCTGCTGAAAGTGGACCA | 4517 |
| LbCas12a_NNK_496 | ATTTTGTGCTGGCCTATGATNNKCTGCTGAAAGTGGACCATAT | 4518 |
| LbCas12a_NNK_497 | TTGTGCTGGCCTATGATATTNNKCTGAAAGTGGACCATATTTA | 4519 |
| LbCas12a_NNK_498 | TGCTGGCCTATGATATTCTGNNKAAAGTGGACCATATTTATGA | 4520 |
| LbCas12a_NNK_499 | TGGCCTATGATATTCTGCTGNNKGTGGACCATATTTATGATGC | 4521 |

TABLE 3-continued

Primers for creating LbCas12a Saturation Mutagenesis Library

| Name | Sequence (5'→3') | SEQ ID NO |
|---|---|---|
| LbCas12a_NNK_500 | CCTATGATATTCTGCTGAAANNKGACCATATTTATGATGCCAT | 4522 |
| LbCas12a_NNK_501 | ATGATATTCTGCTGAAAGTGNNKCATATTTATGATGCCATTCG | 4523 |
| LbCas12a_NNK_502 | ATATTCTGCTGAAAGTGGACNNKATTTATGATGCCATTCGCAA | 4524 |
| LbCas12a_NNK_503 | TTCTGCTGAAAGTGGACCATNNKTATGATGCCATTCGCAATTA | 4525 |
| LbCas12a_NNK_504 | TGCTGAAAGTGGACCATATTNNKGATGCCATTCGCAATTATGT | 4526 |
| LbCas12a_NNK_505 | TGAAAGTGGACCATATTTATNNKGCCATTCGCAATTATGTTAC | 4527 |
| LbCas12a_NNK_506 | AAGTGGACCATATTTATGATNNKATTCGCAATTATGTTACCCA | 4528 |
| LbCas12a_NNK_507 | TGGACCATATTTATGATGCCNNKCGCAATTATGTTACCCAGAA | 4529 |
| LbCas12a_NNK_508 | ACCATATTTATGATGCCATTNNKAATTATGTTACCCAGAAACC | 4530 |
| LbCas12a_NNK_509 | ATATTTATGATGCCATTCGCNNKTATGTTACCCAGAAACCGTA | 4531 |
| LbCas12a_NNK_510 | TTTATGATGCCATTCGCAATNNKGTTACCCAGAAACCGTATAG | 4532 |
| LbCas12a_NNK_511 | ATGATGCCATTCGCAATTATNNKACCCAGAAACCGTATAGCAA | 4533 |
| LbCas12a_NNK_512 | ATGCCATTCGCAATTATGTTNNKCAGAAACCGTATAGCAAAGA | 4534 |
| LbCas12a_NNK_513 | CCATTCGCAATTATGTTACCNNKAAACCGTATAGCAAAGACAA | 4535 |
| LbCas12a_NNK_514 | TTCGCAATTATGTTACCCAGNNKCCGTATAGCAAAGACAAGTT | 4536 |
| LbCas12a_NNK_515 | GCAATTATGTTACCCAGAAANNKTATAGCAAAGACAAGTTCAA | 4537 |
| LbCas12a_NNK_516 | ATTATGTTACCCAGAAACCGNNKAGCAAAGACAAGTTCAAACT | 4538 |
| LbCas12a_NNK_517 | ATGTTACCCAGAAACCGTATNNKAAAGACAAGTTCAAACTGTA | 4539 |
| LbCas12a_NNK_518 | TTACCCAGAAACCGTATAGCNNKGACAAGTTCAAACTGTACTT | 4540 |
| LbCas12a_NNK_519 | CCCAGAAACCGTATAGCAAANNKAAGTTCAAACTGTACTTTCA | 4541 |
| LbCas12a_NNK_520 | AGAAACCGTATAGCAAAGACNNKTTCAAACTGTACTTTCAGAA | 4542 |
| LbCas12a_NNK_521 | AACCGTATAGCAAAGACAAGNNKAAACTGTACTTTCAGAACCC | 4543 |
| LbCas12a_NNK_522 | CGTATAGCAAAGACAAGTTCNNKCTGTACTTTCAGAACCCGCA | 4544 |
| LbCas12a_NNK_523 | ATAGCAAAGACAAGTTCAAANNKTACTTTCAGAACCCGCAGTT | 4545 |
| LbCas12a_NNK_524 | GCAAAGACAAGTTCAAACTGNNKTTTCAGAACCCGCAGTTTAT | 4546 |
| LbCas12a_NNK_525 | AAGACAAGTTCAAACTGTACNNKCAGAACCCGCAGTTTATGGG | 4547 |
| LbCas12a_NNK_526 | ACAAGTTCAAACTGTACTTTNNKAACCCGCAGTTTATGGGTGG | 4548 |
| LbCas12a_NNK_527 | AGTTCAAACTGTACTTTCAGNNKCCGCAGTTTATGGGTGGTTG | 4549 |
| LbCas12a_NNK_528 | TCAAACTGTACTTTCAGAACNNKCAGTTTATGGGTGGTTGGGA | 4550 |
| LbCas12a_NNK_529 | AACTGTACTTTCAGAACCCGNNKTTTATGGGTGGTTGGGATAA | 4551 |
| LbCas12a_NNK_530 | TGTACTTTCAGAACCCGCAGNNKATGGGTGGTTGGGATAAAGA | 4552 |
| LbCas12a_NNK_531 | ACTTTCAGAACCCGCAGTTTNNKGGTGGTTGGGATAAAGATAA | 4553 |
| LbCas12a_NNK_532 | TTCAGAACCCGCAGTTTATGNNKGGTTGGGATAAAGATAAAGA | 4554 |
| LbCas12a_NNK_533 | AGAACCCGCAGTTTATGGGTNNKTGGGATAAAGATAAAGAAAC | 4555 |
| LbCas12a_NNK_534 | ACCCGCAGTTTATGGGTGGTNNKGATAAAGATAAAGAAACCGA | 4556 |
| LbCas12a_NNK_535 | CGCAGTTTATGGGTGGTTGGNNKAAAGATAAAGAAACCGATTA | 4557 |
| LbCas12a_NNK_536 | AGTTTATGGGTGGTTGGGATNNKGATAAAGAAACCGATTATCG | 4558 |
| LbCas12a_NNK_537 | TTATGGGTGGTTGGGATAAANNKAAAGAAACCGATTATCGTGC | 4559 |

TABLE 3-continued

Primers for creating LbCas12a Saturation Mutagenesis Library

| Name | Sequence (5'→3') | SEQ ID NO |
|---|---|---|
| LbCas12a_NNK_538 | TGGGTGGTTGGGATAAAGATNNKGAAACCGATTATCGTGCCAC | 4560 |
| LbCas12a_NNK_539 | GTGGTTGGGATAAAGATAAANNKACCGATTATCGTGCCACCAT | 4561 |
| LbCas12a_NNK_540 | GTTGGGATAAAGATAAAGAANNKGATTATCGTGCCACCATCCT | 4562 |
| LbCas12a_NNK_541 | GGGATAAAGATAAAGAAACCNNKTATCGTGCCACCATCCTGCG | 4563 |
| LbCas12a_NNK_542 | ATAAAGATAAAGAAACCGATNNKCGTGCCACCATCCTGCGTTA | 4564 |
| LbCas12a_NNK_543 | AAGATAAAGAAACCGATTATNNKGCCACCATCCTGCGTTATGG | 4565 |
| LbCas12a_NNK_544 | ATAAAGAAACCGATTATCGTNNKACCATCCTGCGTTATGGTAG | 4566 |
| LbCas12a_NNK_545 | AAGAAACCGATTATCGTGCCNNKATCCTGCGTTATGGTAGTAA | 4567 |
| LbCas12a_NNK_546 | AAACCGATTATCGTGCCACCNNKCTGCGTTATGGTAGTAAATA | 4568 |
| LbCas12a_NNK_547 | CCGATTATCGTGCCACCATCNNKCGTTATGGTAGTAAATACTA | 4569 |
| LbCas12a_NNK_548 | ATTATCGTGCCACCATCCTGNNKTATGGTAGTAAATACTATCT | 4570 |
| LbCas12a_NNK_549 | ATCGTGCCACCATCCTGCGTNNKGGTAGTAAATACTATCTGGC | 4571 |
| LbCas12a_NNK_550 | GTGCCACCATCCTGCGTTATNNKAGTAAATACTATCTGGCCAT | 4572 |
| LbCas12a_NNK_551 | CCACCATCCTGCGTTATGGTNNKAAATACTATCTGGCCATCAT | 4573 |
| LbCas12a_NNK_552 | CCATCCTGCGTTATGGTAGTNNKTACTATCTGGCCATCATGGA | 4574 |
| LbCas12a_NNK_553 | TCCTGCGTTATGGTAGTAAANNKTATCTGGCCATCATGGACAA | 4575 |
| LbCas12a_NNK_554 | TGCGTTATGGTAGTAAATACNNKCTGGCCATCATGGACAAAAA | 4576 |
| LbCas12a_NNK_555 | GTTATGGTAGTAAATACTATNNKGCCATCATGGACAAAAAATA | 4577 |
| LbCas12a_NNK_556 | ATGGTAGTAAATACTATCTGNNKATCATGGACAAAAAATACGC | 4578 |
| LbCas12a_NNK_557 | GTAGTAAATACTATCTGGCCNNKATGGACAAAAAATACGCAAA | 4579 |
| LbCas12a_NNK_558 | GTAAATACTATCTGGCCATCNNKGACAAAAAATACGCAAAATG | 4580 |
| LbCas12a_NNK_559 | AATACTATCTGGCCATCATGNNKAAAAAATACGCAAAATGCCT | 4581 |
| LbCas12a_NNK_560 | ACTATCTGGCCATCATGGACNNKAAATACGCAAAATGCCTGCA | 4582 |
| LbCas12a_NNK_561 | ATCTGGCCATCATGGACAAANNKTACGCAAAATGCCTGCAGAA | 4583 |
| LbCas12a_NNK_562 | TGGCCATCATGGACAAAAAANNKGCAAAATGCCTGCAGAAAAT | 4584 |
| LbCas12a_NNK_563 | CCATCATGGACAAAAAATACNNKAAATGCCTGCAGAAAATCGA | 4585 |
| LbCas12a_NNK_564 | TCATGGACAAAAAATACGCANNKTGCCTGCAGAAAATCGACAA | 4586 |
| LbCas12a_NNK_565 | TGGACAAAAAATACGCAAAANNKCTGCAGAAAATCGACAAAGA | 4587 |
| LbCas12a_NNK_566 | ACAAAAAATACGCAAAATGCNNKCAGAAAATCGACAAAGATGA | 4588 |
| LbCas12a_NNK_567 | AAAAATACGCAAAATGCCTGNNKAAAATCGACAAAGATGATGT | 4589 |
| LbCas12a_NNK_568 | AATACGCAAAATGCCTGCAGNNKATCGACAAAGATGATGTGAA | 4590 |
| LbCas12a_NNK_569 | ACGCAAAATGCCTGCAGAAANNKGACAAAGATGATGTGAATGG | 4591 |
| LbCas12a_NNK_570 | CAAAATGCCTGCAGAAAATCNNKAAAGATGATGTGAATGGCAA | 4592 |
| LbCas12a_NNK_571 | AATGCCTGCAGAAAATCGACNNKGATGATGTGAATGGCAACTA | 4593 |
| LbCas12a_NNK_572 | GCCTGCAGAAAATCGACAAANNKGATGTGAATGGCAACTATGA | 4594 |
| LbCas12a_NNK_573 | TGCAGAAAATCGACAAAGATNNKGTGAATGGCAACTATGAAAA | 4595 |
| LbCas12a_NNK_574 | AGAAAATCGACAAAGATGATNNKAATGGCAACTATGAAAAAAT | 4596 |

TABLE 3-continued

Primers for creating LbCas12a Saturation Mutagenesis Library

| Name | Sequence (5'→3') | SEQ ID NO |
|---|---|---|
| LbCas12a_NNK_575 | AAATCGACAAAGATGATGTGNNKGGCAACTATGAAAAAATCAA | 4597 |
| LbCas12a_NNK_576 | TCGACAAAGATGATGTGAATNNKAACTATGAAAAAATCAACTA | 4598 |
| LbCas12a_NNK_577 | ACAAAGATGATGTGAATGGCNNKTATGAAAAAATCAACTACAA | 4599 |
| LbCas12a_NNK_578 | AAGATGATGTGAATGGCAACNNKGAAAAAATCAACTACAAACT | 4600 |
| LbCas12a_NNK_579 | ATGATGTGAATGGCAACTATNNKAAAATCAACTACAAACTGCT | 4601 |
| LbCas12a_NNK_580 | ATGTGAATGGCAACTATGAANNKATCAACTACAAACTGCTGCC | 4602 |
| LbCas12a_NNK_581 | TGAATGGCAACTATGAAAAANNKAACTACAAACTGCTGCCTGG | 4603 |
| LbCas12a_NNK_582 | ATGGCAACTATGAAAAAATCNNKTACAAACTGCTGCCTGGTCC | 4604 |
| LbCas12a_NNK_583 | GCAACTATGAAAAAATCAACNNKAAACTGCTGCCTGGTCCGAA | 4605 |
| LbCas12a_NNK_584 | ACTATGAAAAAATCAACTACNNKCTGCTGCCTGGTCCGAATAA | 4606 |
| LbCas12a_NNK_585 | ATGAAAAAATCAACTACAAANNKCTGCCTGGTCCGAATAAAAT | 4607 |
| LbCas12a_NNK_586 | AAAAAATCAACTACAAACTGNNKCCTGGTCCGAATAAAATGCT | 4608 |
| LbCas12a_NNK_587 | AAATCAACTACAAACTGCTGNNKGGTCCGAATAAAATGCTGCC | 4609 |
| LbCas12a_NNK_588 | TCAACTACAAACTGCTGCCTNNKCCGAATAAAATGCTGCCGAA | 4610 |
| LbCas12a_NNK_589 | ACTACAAACTGCTGCCTGGTNNKAATAAAATGCTGCCGAAAGT | 4611 |
| LbCas12a_NNK_590 | ACAAACTGCTGCCTGGTCCGNNKAAAATGCTGCCGAAAGTGTT | 4612 |
| LbCas12a_NNK_591 | AACTGCTGCCTGGTCCGAATNNKATGCTGCCGAAAGTGTTCTT | 4613 |
| LbCas12a_NNK_592 | TGCTGCCTGGTCCGAATAAANNKCTGCCGAAAGTGTTCTTTAG | 4614 |
| LbCas12a_NNK_593 | TGCCTGGTCCGAATAAAATGNNKCCGAAAGTGTTCTTTAGCAA | 4615 |
| LbCas12a_NNK_594 | CTGGTCCGAATAAAATGCTGNNKAAAGTGTTCTTTAGCAAGAA | 4616 |
| LbCas12a_NNK_595 | GTCCGAATAAAATGCTGCCGNNKGTGTTCTTTAGCAAGAAATG | 4617 |
| LbCas12a_NNK_596 | CGAATAAAATGCTGCCGAAANNKTTCTTTAGCAAGAAATGGAT | 4618 |
| LbCas12a_NNK_597 | ATAAAATGCTGCCGAAAGTGNNKTTTAGCAAGAAATGGATGGC | 4619 |
| LbCas12a_NNK_598 | AAATGCTGCCGAAAGTGTTCNNKAGCAAGAAATGGATGGCCTA | 4620 |
| LbCas12a_NNK_599 | TGCTGCCGAAAGTGTTCTTTNNKAAGAAATGGATGGCCTATTA | 4621 |
| LbCas12a_NNK_600 | TGCCGAAAGTGTTCTTTAGCNNKAAATGGATGGCCTATTATAA | 4622 |
| LbCas12a_NNK_601 | CGAAAGTGTTCTTTAGCAAGNNKTGGATGGCCTATTATAACCC | 4623 |
| LbCas12a_NNK_602 | AAGTGTTCTTTAGCAAGAAANNKATGGCCTATTATAACCCGAG | 4624 |
| LbCas12a_NNK_603 | TGTTCTTTAGCAAGAAATGGNNKGCCTATTATAACCCGAGCGA | 4625 |
| LbCas12a_NNK_604 | TCTTTAGCAAGAAATGGATGNNKTATTATAACCCGAGCGAGGA | 4626 |
| LbCas12a_NNK_605 | TTAGCAAGAAATGGATGGCCNNKTATAACCCGAGCGAGGATAT | 4627 |
| LbCas12a_NNK_606 | GCAAGAAATGGATGGCCTATNNKAACCCGAGCGAGGATATTCA | 4628 |
| LbCas12a_NNK_607 | AGAAATGGATGGCCTATTATNNKCCGAGCGAGGATATTCAAAA | 4629 |
| LbCas12a_NNK_608 | AATGGATGGCCTATTATAACNNKAGCGAGGATATTCAAAAGAT | 4630 |
| LbCas12a_NNK_609 | GGATGGCCTATTATAACCCGNNKGAGGATATTCAAAAGATCTA | 4631 |
| LbCas12a_NNK_610 | TGGCCTATTATAACCCGAGCNNKGATATTCAAAAGATCTACAA | 4632 |
| LbCas12a_NNK_611 | cCTATTATAACCCGAGCGAGNNKATTCAAAAGATCTACAAAAA | 4633 |
| LbCas12a_NNK_612 | ATTATAACCCGAGCGAGGATNNKCAAAAGATCTACAAAAATGG | 4634 |

TABLE 3-continued

Primers for creating LbCas12a Saturation Mutagenesis Library

| Name | Sequence (5'→3') | SEQ ID NO |
|---|---|---|
| LbCas12a_NNK_613 | ATAACCCGAGCGAGGATATTNNKAAGATCTACAAAAATGGCAC | 4635 |
| LbCas12a_NNK_614 | ACCCGAGCGAGGATATTCAANNKATCTACAAAAATGGCACCTT | 4636 |
| LbCas12a_NNK_615 | CGAGCGAGGATATTCAAAAGNNKTACAAAAATGGCACCTTTAA | 4637 |
| LbCas12a_NNK_616 | GCGAGGATATTCAAAAGATCNNKAAAAATGGCACCTTTAAAAA | 4638 |
| LbCas12a_NNK_617 | AGGATATTCAAAAGATCTACNNKAATGGCACCTTTAAAAAGGG | 4639 |
| LbCas12a_NNK_618 | ATATTCAAAAGATCTACAAANNKGGCACCTTTAAAAAGGGCGA | 4640 |
| LbCas12a_NNK_619 | TTCAAAAGATCTACAAAAATNNKACCTTTAAAAAGGGCGACAT | 4641 |
| LbCas12a_NNK_620 | AAAAGATCTACAAAAATGGCNNKTTTAAAAAGGGCGACATGTT | 4642 |
| LbCas12a_NNK_621 | AGATCTACAAAAATGGCACCNNKAAAAAGGGCGACATGTTCAA | 4643 |
| LbCas12a_NNK_622 | TCTACAAAAATGGCACCTTTNNKAAGGGCGACATGTTCAATCT | 4644 |
| LbCas12a_NNK_623 | ACAAAAATGGCACCTTTAAANNKGGCGACATGTTCAATCTGAA | 4645 |
| LbCas12a_NNK_624 | AAAATGGCACCTTTAAAAAGNNKGACATGTTCAATCTGAACGA | 4646 |
| LbCas12a_NNK_625 | ATGGCACCTTTAAAAAGGGCNNKATGTTCAATCTGAACGATTG | 4647 |
| LbCas12a_NNK_626 | GCACCTTTAAAAAGGGCGACNNKTTCAATCTGAACGATTGCCA | 4648 |
| LbCas12a_NNK_627 | CCTTTAAAAAGGGCGACATGNNKAATCTGAACGATTGCCACAA | 4649 |
| LbCas12a_NNK_628 | TTAAAAAGGGCGACATGTTCNNKCTGAACGATTGCCACAAACT | 4650 |
| LbCas12a_NNK_629 | AAAAGGGCGACATGTTCAATNNKAACGATTGCCACAAACTGAT | 4651 |
| LbCas12a_NNK_630 | AGGGCGACATGTTCAATCTGNNKGATTGCCACAAACTGATCGA | 4652 |
| LbCas12a_NNK_631 | GCGACATGTTCAATCTGAACNNKTGCCACAAACTGATCGATTT | 4653 |
| LbCas12a_NNK_632 | ACATGTTCAATCTGAACGATNNKCACAAACTGATCGATTTCTT | 4654 |
| LbCas12a_NNK_633 | TGTTCAATCTGAACGATTGCNNKAAACTGATCGATTTCTTCAA | 4655 |
| LbCas12a_NNK_634 | TCAATCTGAACGATTGCCACNNKCTGATCGATTTCTTCAAAGA | 4656 |
| LbCas12a_NNK_635 | ATCTGAACGATTGCCACAAANNKATCGATTTCTTCAAAGATTC | 4657 |
| LbCas12a_NNK_636 | TGAACGATTGCCACAAACTGNNKGATTTCTTCAAAGATTCAAT | 4658 |
| LbCas12a_NNK_637 | ACGATTGCCACAAACTGATCNNKTTCTTCAAAGATTCAATTTC | 4659 |
| LbCas12a_NNK_638 | ATTGCCACAAACTGATCGATNNKTTCAAAGATTCAATTTCGCG | 4660 |
| LbCas12a_NNK_639 | GCCACAAACTGATCGATTTCNNKAAAGATTCAATTTCGCGTTA | 4661 |
| LbCas12a_NNK_640 | ACAAACTGATCGATTTCTTCNNKGATTCAATTTCGCGTTATCC | 4662 |
| LbCas12a_NNK_641 | AACTGATCGATTTCTTCAAANNKTCAATTTCGCGTTATCCGAA | 4663 |
| LbCas12a_NNK_642 | TGATCGATTTCTTCAAAGATNNKATTTCGCGTTATCCGAAATG | 4664 |
| LbCas12a_NNK_643 | TCGATTTCTTCAAAGATTCANNKTCGCGTTATCCGAAATGGTC | 4665 |
| LbCas12a_NNK_644 | ATTTCTTCAAAGATTCAATTNNKCGTTATCCGAAATGGTCCAA | 4666 |
| LbCas12a_NNK_645 | TCTTCAAAGATTCAATTTCGNNKTATCCGAAATGGTCCAATGC | 4667 |
| LbCas12a_NNK_646 | TCAAAGATTCAATTTCGCGTNNKCCGAAATGGTCCAATGCCTA | 4668 |
| LbCas12a_NNK_647 | AAGATTCAATTTCGCGTTATNNKAAATGGTCCAATGCCTATGA | 4669 |
| LbCas12a_NNK_648 | ATTCAATTTCGCGTTATCCGNNKTGGTCCAATGCCTATGATTT | 4670 |
| LbCas12a_NNK_649 | CAATTTCGCGTTATCCGAAANNKTCCAATGCCTATGATTTTAA | 4671 |

TABLE 3-continued

Primers for creating LbCas12a Saturation Mutagenesis Library

| Name | Sequence (5'→3') | SEQ ID NO |
|---|---|---|
| LbCas12a_NNK_650 | TTTCGCGTTATCCGAAATGGNNKAATGCCTATGATTTTAACTT | 4672 |
| LbCas12a_NNK_651 | CGCGTTATCCGAAATGGTCCNNKGCCTATGATTTTAACTTTAG | 4673 |
| LbCas12a_NNK_652 | GTTATCCGAAATGGTCCAATNNKTATGATTTTAACTTTAGCGA | 4674 |
| LbCas12a_NNK_653 | ATCCGAAATGGTCCAATGCCNNKGATTTTAACTTTAGCGAAAC | 4675 |
| LbCas12a_NNK_654 | CGAAATGGTCCAATGCCTATNNKTTTAACTTTAGCGAAACCGA | 4676 |
| LbCas12a_NNK_655 | AATGGTCCAATGCCTATGATNNKAACTTTAGCGAAACCGAAAA | 4677 |
| LbCas12a_NNK_656 | GGTCCAATGCCTATGATTTTNNKTTTAGCGAAACCGAAAATA | 4678 |
| LbCas12a_NNK_657 | CCAATGCCTATGATTTTAACNNKAGCGAAACCGAAAATACAA | 4679 |
| LbCas12a_NNK_658 | ATGCCTATGATTTTAACTTTNNKGAAACCGAAAATACAAAGA | 4680 |
| LbCas12a_NNK_659 | CCTATGATTTTAACTTTAGCNNKACCGAAAATACAAAGACAT | 4681 |
| LbCas12a_NNK_660 | ATGATTTTAACTTTAGCGAANNKGAAAATACAAAGACATTGC | 4682 |
| LbCas12a_NNK_661 | ATTTTAACTTTAGCGAAACCNNKAAATACAAAGACATTGCCGG | 4683 |
| LbCas12a_NNK_662 | TTAACTTTAGCGAAACCGAANNKTACAAAGACATTGCCGGTTT | 4684 |
| LbCas12a_NNK_663 | ACTTTAGCGAAACCGAAAANNKAAAGACATTGCCGGTTTTTA | 4685 |
| LbCas12a_NNK_664 | TTAGCGAAACCGAAAAATACNNKGACATTGCCGGTTTTTATCG | 4686 |
| LbCas12a_NNK_665 | GCGAAACCGAAAAATACAAANNKATTGCCGGTTTTTATCGCGA | 4687 |
| LbCas12a_NNK_666 | AAACCGAAAAATACAAAGACNNKGCCGGTTTTTATCGCGAAGT | 4688 |
| LbCas12a_NNK_667 | CCGAAAAATACAAAGACATTNNKGGTTTTTATCGCGAAGTGGA | 4689 |
| LbCas12a_NNK_668 | AAAAATACAAAGACATTGCCNNKTTTTATCGCGAAGTGGAAGA | 4690 |
| LbCas12a_NNK_669 | AATACAAAGACATTGCCGGTNNKTATCGCGAAGTGGAAGAACA | 4691 |
| LbCas12a_NNK_670 | ACAAAGACATTGCCGGTTTTNNKCGCGAAGTGGAAGAACAGGG | 4692 |
| LbCas12a_NNK_671 | AAGACATTGCCGGTTTTTATNNKGAAGTGGAAGAACAGGGCTA | 4693 |
| LbCas12a_NNK_672 | ACATTGCCGGTTTTTATCGCNNKGTGGAAGAACAGGGCTATAA | 4694 |
| LbCas12a_NNK_673 | TTGCCGGTTTTTATCGCGAANNKGAAGAACAGGGCTATAAAGT | 4695 |
| LbCas12a_NNK_674 | CCGGTTTTTATCGCGAAGTGNNKGAACAGGGCTATAAAGTGAG | 4696 |
| LbCas12a_NNK_675 | GTTTTTATCGCGAAGTGGAANNKCAGGGCTATAAAGTGAGCTT | 4697 |
| LbCas12a_NNK_676 | TTTATCGCGAAGTGGAAGAANNKGGCTATAAAGTGAGCTTTGA | 4698 |
| LbCas12a_NNK_677 | ATCGCGAAGTGGAAGAACAGNNKTATAAAGTGAGCTTTGAAAG | 4699 |
| LbCas12a_NNK_678 | GCGAAGTGGAAGAACAGGGCNNKAAAGTGAGCTTTGAAAGCGC | 4700 |
| LbCas12a_NNK_679 | AAGTGGAAGAACAGGGCTATNNKGTGAGCTTTGAAAGCGCAAG | 4701 |
| LbCas12a_NNK_680 | TGGAAGAACAGGGCTATAAANNKAGCTTTGAAAGCGCAAGCAA | 4702 |
| LbCas12a_NNK_681 | AAGAACAGGGCTATAAAGTGNNKTTTGAAAGCGCAAGCAAAAA | 4703 |
| LbCas12a_NNK_682 | AACAGGGCTATAAAGTGAGCNNKGAAAGCGCAAGCAAAAAAGA | 4704 |
| LbCas12a_NNK_683 | AGGGCTATAAAGTGAGCTTTNNKAGCGCAAGCAAAAAAGAGGT | 4705 |
| LbCas12a_NNK_684 | GCTATAAAGTGAGCTTTGAANNKGCAAGCAAAAAAGAGGTTGA | 4706 |
| LbCas12a_NNK_685 | ATAAAGTGAGCTTTGAAAGCNNKAGCAAAAAAGAGGTTGATAA | 4707 |
| LbCas12a_NNK_686 | AAGTGAGCTTTGAAAGCGCANNKAAAAAAGAGGTTGATAAGCT | 4708 |
| LbCas12a_NNK_687 | TGAGCTTTGAAAGCGCAAGCNNKAAAGAGGTTGATAAGCTGGT | 4709 |

TABLE 3-continued

Primers for creating LbCas12a Saturation Mutagenesis Library

| Name | Sequence (5'→3') | SEQ ID NO |
|---|---|---|
| LbCas12a_NNK_688 | GCTTTGAAAGCGCAAGCAAANNKGAGGTTGATAAGCTGGTTGA | 4710 |
| LbCas12a_NNK_689 | TTGAAAGCGCAAGCAAAAAANNKGTTGATAAGCTGGTTGAAGA | 4711 |
| LbCas12a_NNK_690 | AAAGCGCAAGCAAAAAAGAGNNKGATAAGCTGGTTGAAGAGGG | 4712 |
| LbCas12a_NNK_691 | GCGCAAGCAAAAAAGAGGTTNNKAAGCTGGTTGAAGAGGGCAA | 4713 |
| LbCas12a_NNK_692 | CAAGCAAAAAAGAGGTTGATNNKCTGGTTGAAGAGGGCAAACT | 4714 |
| LbCas12a_NNK_693 | GCAAAAAAGAGGTTGATAAGNNKGTTGAAGAGGGCAAACTGTA | 4715 |
| LbCas12a_NNK_694 | AAAAAGAGGTTGATAAGCTGNNKGAAGAGGGCAAACTGTATAT | 4716 |
| LbCas12a_NNK_695 | AAGAGGTTGATAAGCTGGTTNNKGAGGGCAAACTGTATATGTT | 4717 |
| LbCas12a_NNK_696 | AGGTTGATAAGCTGGTTGAANNKGGCAAACTGTATATGTTCCA | 4718 |
| LbCas12a_NNK_697 | TTGATAAGCTGGTTGAAGAGNNKAAACTGTATATGTTCCAGAT | 4719 |
| LbCas12a_NNK_698 | ATAAGCTGGTTGAAGAGGGCNNKCTGTATATGTTCCAGATTTA | 4720 |
| LbCas12a_NNK_699 | AGCTGGTTGAAGAGGGCAAANNKTATATGTTCCAGATTTACAA | 4721 |
| LbCas12a_NNK_700 | TGGTTGAAGAGGGCAAACTGNNKATGTTCCAGATTTACAACAA | 4722 |
| LbCas12a_NNK_701 | TTGAAGAGGGCAAACTGTATNNKTTCCAGATTTACAACAAAGA | 4723 |
| LbCas12a_NNK_702 | AAGAGGGCAAACTGTATATGNNKCAGATTTACAACAAAGATTT | 4724 |
| LbCas12a_NNK_703 | AGGGCAAACTGTATATGTTCNNKATTTACAACAAAGATTTTAG | 4725 |
| LbCas12a_NNK_704 | GCAAACTGTATATGTTCCAGNNKTACAACAAAGATTTTAGCGA | 4726 |
| LbCas12a_NNK_705 | AACTGTATATGTTCCAGATTNNKAACAAAGATTTTAGCGACAA | 4727 |
| LbCas12a_NNK_706 | TGTATATGTTCCAGATTTACNNKAAAGATTTTAGCGACAAAAG | 4728 |
| LbCas12a_NNK_707 | ATATGTTCCAGATTTACAACNNKGATTTTAGCGACAAAAGCCA | 4729 |
| LbCas12a_NNK_708 | TGTTCCAGATTTACAACAAANNKTTTAGCGACAAAAGCCATGG | 4730 |
| LbCas12a_NNK_709 | TCCAGATTTACAACAAAGATNNKAGCGACAAAAGCCATGGCAC | 4731 |
| LbCas12a_NNK_710 | AGATTTACAACAAAGATTTTNNKGACAAAAGCCATGGCACCCC | 4732 |
| LbCas12a_NNK_711 | TTTACAACAAAGATTTTAGCNNKAAAAGCCATGGCACCCCGAA | 4733 |
| LbCas12a_NNK_712 | ACAACAAAGATTTTAGCGACNNKAGCCATGGCACCCCGAATCT | 4734 |
| LbCas12a_NNK_713 | ACAAAGATTTTAGCGACAAANNKCATGGCACCCCGAATCTGCA | 4735 |
| LbCas12a_NNK_714 | AAGATTTTAGCGACAAAAGCNNKGGCACCCCGAATCTGCATAC | 4736 |
| LbCas12a_NNK_715 | ATTTTAGCGACAAAAGCCATNNKACCCCGAATCTGCATACCAT | 4737 |
| LbCas12a_NNK_716 | TTAGCGACAAAAGCCATGGCNNKCCGAATCTGCATACCATGTA | 4738 |
| LbCas12a_NNK_717 | GCGACAAAAGCCATGGCACCNNKAATCTGCATACCATGTACTT | 4739 |
| LbCas12a_NNK_718 | ACAAAGCCATGGCACCCCGNNKCTGCATACCATGTACTTTAA | 4740 |
| LbCas12a_NNK_719 | AAAGCCATGGCACCCCGAATNNKCATACCATGTACTTTAAACT | 4741 |
| LbCas12a_NNK_720 | GCCATGGCACCCCGAATCTGNNKACCATGTACTTTAAACTGCT | 4742 |
| LbCas12a_NNK_721 | ATGGCACCCCGAATCTGCATNNKATGTACTTTAAACTGCTGTT | 4743 |
| LbCas12a_NNK_722 | GCACCCCGAATCTGCATACCNNKTACTTTAAACTGCTGTTCGA | 4744 |
| LbCas12a_NNK_723 | CCCCGAATCTGCATACCATGNNKTTTAAACTGCTGTTCGACGA | 4745 |
| LbCas12a_NNK_724 | CGAATCTGCATACCATGTACNNKAAACTGCTGTTCGACGAAAA | 4746 |

TABLE 3-continued

Primers for creating LbCas12a Saturation Mutagenesis Library

| Name | Sequence (5'→3') | SEQ ID NO |
|---|---|---|
| LbCas12a_NNK_725 | ATCTGCATACCATGTACTTTNNKCTGCTGTTCGACGAAAATAA | 4747 |
| LbCas12a_NNK_726 | TGCATACCATGTACTTTAAANNKCTGTTCGACGAAAATAACCA | 4748 |
| LbCas12a_NNK_727 | ATACCATGTACTTTAAACTGNNKTTCGACGAAAATAACCATGG | 4749 |
| LbCas12a_NNK_728 | CCATGTACTTTAAACTGCTGNNKGACGAAAATAACCATGGTCA | 4750 |
| LbCas12a_NNK_729 | TGTACTTTAAACTGCTGTTCNNKGAAAATAACCATGGTCAGAT | 4751 |
| LbCas12a_NNK_730 | ACTTTAAACTGCTGTTCGACNNKAATAACCATGGTCAGATTCG | 4752 |
| LbCas12a_NNK_731 | TTAAACTGCTGTTCGACGAANNKAACCATGGTCAGATTCGTCT | 4753 |
| LbCas12a_NNK_732 | AACTGCTGTTCGACGAAAATNNKCATGGTCAGATTCGTCTGAG | 4754 |
| LbCas12a_NNK_733 | TGCTGTTCGACGAAAATAACNNKGGTCAGATTCGTCTGAGCGG | 4755 |
| LbCas12a_NNK_734 | TGTTCGACGAAAATAACCATNNKCAGATTCGTCTGAGCGGTGG | 4756 |
| LbCas12a_NNK_735 | TCGACGAAAATAACCATGGTNNKATTCGTCTGAGCGGTGGTGC | 4757 |
| LbCas12a_NNK_736 | ACGAAAATAACCATGGTCAGNNKCGTCTGAGCGGTGGTGCCGA | 4758 |
| LbCas12a_NNK_737 | AAAATAACCATGGTCAGATTNNKCTGAGCGGTGGTGCCGAACT | 4759 |
| LbCas12a_NNK_738 | ATAACCATGGTCAGATTCGTNNKAGCGGTGGTGCCGAACTGTT | 4760 |
| LbCas12a_NNK_739 | ACCATGGTCAGATTCGTCTGNNKGGTGGTGCCGAACTGTTTAT | 4761 |
| LbCas12a_NNK_740 | ATGGTCAGATTCGTCTGAGCNNKGGTGCCGAACTGTTTATGCG | 4762 |
| LbCas12a_NNK_741 | GTCAGATTCGTCTGAGCGGTNNKGCCGAACTGTTTATGCGTCG | 4763 |
| LbCas12a_NNK_742 | AGATTCGTCTGAGCGGTGGTNNKGAACTGTTTATGCGTCGTGC | 4764 |
| LbCas12a_NNK_743 | TTCGTCTGAGCGGTGGTGCCNNKCTGTTTATGCGTCGTGCAAG | 4765 |
| LbCas12a_NNK_744 | GTCTGAGCGGTGGTGCCGAANNKTTTATGCGTCGTGCAAGTCT | 4766 |
| LbCas12a_NNK_745 | TGAGCGGTGGTGCCGAACTGNNKATGCGTCGTGCAAGTCTGAA | 4767 |
| LbCas12a_NNK_746 | GCGGTGGTGCCGAACTGTTTNNKCGTCGTGCAAGTCTGAAAAA | 4768 |
| LbCas12a_NNK_747 | GTGGTGCCGAACTGTTTATGNNKCGTGCAAGTCTGAAAAAAGA | 4769 |
| LbCas12a_NNK_748 | GTGCCGAACTGTTTATGCGTNNKGCAAGTCTGAAAAAAGAAGA | 4770 |
| LbCas12a_NNK_749 | CCGAACTGTTTATGCGTCGTNNKAGTCTGAAAAAAGAAGAACT | 4771 |
| LbCas12a_NNK_750 | AACTGTTTATGCGTCGTGCANNKCTGAAAAAAGAAGAACTGGT | 4772 |
| LbCas12a_NNK_751 | TGTTTATGCGTCGTGCAAGTNNKAAAAAAGAAGAACTGGTTGT | 4773 |
| LbCas12a_NNK_752 | TTATGCGTCGTGCAAGTCTGNNKAAAGAAGAACTGGTTGTTCA | 4774 |
| LbCas12a_NNK_753 | TGCGTCGTGCAAGTCTGAAANNKGAAGAACTGGTTGTTCATCC | 4775 |
| LbCas12a_NNK_754 | GTCGTGCAAGTCTGAAAAAANNKGAACTGGTTGTTCATCCGGC | 4776 |
| LbCas12a_NNK_755 | GTGCAAGTCTGAAAAAAGAANNKCTGGTTGTTCATCCGGCAAA | 4777 |
| LbCas12a_NNK_756 | CAAGTCTGAAAAAAGAAGAANNKGTTGTTCATCCGGCAAATAG | 4778 |
| LbCas12a_NNK_757 | GTCTGAAAAAAGAAGAACTGNNKGTTCATCCGGCAAATAGCCC | 4779 |
| LbCas12a_NNK_758 | TGAAAAAAGAAGAACTGGTTNNKCATCCGGCAAATAGCCCGAT | 4780 |
| LbCas12a_NNK_759 | AAAAGAAGAACTGGTTGTTNNKCCGGCAAATAGCCCGATTGC | 4781 |
| LbCas12a_NNK_760 | AAGAAGAACTGGTTGTTCATNNKGCAAATAGCCCGATTGCAAA | 4782 |
| LbCas12a_NNK_761 | AAGAACTGGTTGTTCATCCGNNKAATAGCCCGATTGCAAACAA | 4783 |
| LbCas12a_NNK_762 | AACTGGTTGTTCATCCGGCANNKAGCCCGATTGCAAACAAAAA | 4784 |

TABLE 3-continued

Primers for creating LbCas12a Saturation Mutagenesis Library

| Name | Sequence (5'→3') | SEQ ID NO |
|---|---|---|
| LbCas12a_NNK_763 | TGGTTGTTCATCCGGCAAATNNKCCGATTGCAAACAAAAATCC | 4785 |
| LbCas12a_NNK_764 | TTGTTCATCCGGCAAATAGCNNKATTGCAAACAAAAATCCGGA | 4786 |
| LbCas12a_NNK_765 | TTCATCCGGCAAATAGCCCGNNKGCAAACAAAAATCCGGACAA | 4787 |
| LbCas12a_NNK_766 | ATCCGGCAAATAGCCCGATTNNKAACAAAAATCCGGACAATCC | 4788 |
| LbCas12a_NNK_767 | CGGCAAATAGCCCGATTGCANNKAAAAATCCGGACAATCCGAA | 4789 |
| LbCas12a_NNK_768 | CAAATAGCCCGATTGCAAACNNKAATCCGGACAATCCGAAAAA | 4790 |
| LbCas12a_NNK_769 | ATAGCCCGATTGCAAACAAANNKCCGGACAATCCGAAAAAAAC | 4791 |
| LbCas12a_NNK_770 | GCCCGATTGCAAACAAAAATNNKGACAATCCGAAAAAAACCAC | 4792 |
| LbCas12a_NNK_771 | CGATTGCAAACAAAAATCCGNNKAATCCGAAAAAAACCACGAC | 4793 |
| LbCas12a_NNK_772 | TTGCAAACAAAAATCCGGACNNKCCGAAAAAAACCACGACACT | 4794 |
| LbCas12a_NNK_773 | CAAACAAAAATCCGGACAATNNKAAAAAAACCACGACACTGAG | 4795 |
| LbCas12a_NNK_774 | ACAAAAATCCGGACAATCCGNNKAAAACCACGACACTGAGCTA | 4796 |
| LbCas12a_NNK_775 | AAAATCCGGACAATCCGAAANNKACCACGACACTGAGCTATGA | 4797 |
| LbCas12a_NNK_776 | ATCCGGACAATCCGAAAAAANNKACGACACTGAGCTATGATGT | 4798 |
| LbCas12a_NNK_777 | CGGACAATCCGAAAAAAACCNNKACACTGAGCTATGATGTGTA | 4799 |
| LbCas12a_NNK_778 | ACAATCCGAAAAAAACCACGNNKCTGAGCTATGATGTGTATAA | 4800 |
| LbCas12a_NNK_779 | ATCCGAAAAAAACCACGACANNKAGCTATGATGTGTATAAAGA | 4801 |
| LbCas12a_NNK_780 | CGAAAAAACCACGACACTGNNKTATGATGTGTATAAAGACAA | 4802 |
| LbCas12a_NNK_781 | AAAAAACCACGACACTGAGCNNKGATGTGTATAAAGACAAACG | 4803 |
| LbCas12a_NNK_782 | AAACCACGACACTGAGCTATNNKGTGTATAAAGACAAACGTTT | 4804 |
| LbCas12a_NNK_783 | CCACGACACTGAGCTATGATNNKTATAAAGACAAACGTTTTAG | 4805 |
| LbCas12a_NNK_784 | CGACACTGAGCTATGATGTGNNKAAAGACAAACGTTTTAGCGA | 4806 |
| LbCas12a_NNK_785 | CACTGAGCTATGATGTGTATNNKGACAAACGTTTTAGCGAGGA | 4807 |
| LbCas12a_NNK_786 | TGAGCTATGATGTGTATAAANNKAAACGTTTTAGCGAGGATCA | 4808 |
| LbCas12a_NNK_787 | GCTATGATGTGTATAAAGACNNKCGTTTTAGCGAGGATCAGTA | 4809 |
| LbCas12a_NNK_J88 | ATGATGTGTATAAAGACAAANNKTTTAGCGAGGATCAGTATGA | 4810 |
| LbCas12a_NNK_J89 | ATGTGTATAAAGACAAACGTNNKAGCGAGGATCAGTATGAACT | 4811 |
| LbCas12a_NNK_790 | TGTATAAAGACAAACGTTTTNNKGAGGATCAGTATGAACTGCA | 4812 |
| LbCas12a_NNK_J91 | ATAAAGACAAACGTTTTAGCNNKGATCAGTATGAACTGCATAT | 4813 |
| LbCas12a_NNK_792 | AAGACAAACGTTTTAGCGAGNNKCAGTATGAACTGCATATCCC | 4814 |
| LbCas12a_NNK_793 | ACAAACGTTTTAGCGAGGATNNKTATGAACTGCATATCCCGAT | 4815 |
| LbCas12a_NNK_794 | AACGTTTTAGCGAGGATCAGNNKGAACTGCATATCCCGATTGC | 4816 |
| LbCas12a_NNK_795 | GTTTTAGCGAGGATCAGTATNNKCTGCATATCCCGATTGCCAT | 4817 |
| LbCas12a_NNK_796 | TTAGCGAGGATCAGTATGAANNKCATATCCCGATTGCCATCAA | 4818 |
| LbCas12a_NNK_797 | GCGAGGATCAGTATGAACTGNNKATCCCGATTGCCATCAATAA | 4819 |
| LbCas12a_NNK_798 | AGGATCAGTATGAACTGCATNNKCCGATTGCCATCAATAAATG | 4820 |
| LbCas12a_NNK_J99 | ATCAGTATGAACTGCATATCNNKATTGCCATCAATAAATGCCC | 4821 |

TABLE 3-continued

Primers for creating LbCas12a Saturation Mutagenesis Library

| Name | Sequence (5'→3') | SEQ ID NO |
|---|---|---|
| LbCas12a_NNK_800 | AGTATGAACTGCATATCCCGNNKGCCATCAATAAATGCCCGAA | 4822 |
| LbCas12a_NNK_801 | ATGAACTGCATATCCCGATTNNKATCAATAAATGCCCGAAAAA | 4823 |
| LbCas12a_NNK_802 | AACTGCATATCCCGATTGCCNNKAATAAATGCCCGAAAAACAT | 4824 |
| LbCas12a_NNK_803 | TGCATATCCCGATTGCCATCNNKAAATGCCCGAAAAACATCTT | 4825 |
| LbCas12a_NNK_804 | ATATCCCGATTGCCATCAATNNKTGCCCGAAAAACATCTTTAA | 4826 |
| LbCas12a_NNK_805 | TCCCGATTGCCATCAATAAANNKCCGAAAAACATCTTTAAGAT | 4827 |
| LbCas12a_NNK_806 | CGATTGCCATCAATAAATGCNNKAAAAACATCTTTAAGATCAA | 4828 |
| LbCas12a_NNK_807 | TTGCCATCAATAAATGCCCGNNKAACATCTTTAAGATCAACAC | 4829 |
| LbCas12a_NNK_808 | CCATCAATAAATGCCCGAAANNKATCTTTAAGATCAACACCGA | 4830 |
| LbCas12a_NNK_809 | TCAATAAATGCCCGAAAAACNNKTTTAAGATCAACACCGAAGT | 4831 |
| LbCas12a_NNK_810 | ATAAATGCCCGAAAAACATCNNKAAGATCAACACCGAAGTTCG | 4832 |
| LbCas12a_NNK_811 | AATGCCCGAAAAACATCTTTNNKATCAACACCGAAGTTCGCGT | 4833 |
| LbCas12a_NNK_812 | GCCCGAAAAACATCTTTAAGNNKAACACCGAAGTTCGCGTGCT | 4834 |
| LbCas12a_NNK_813 | CGAAAAACATCTTTAAGATCNNKACCGAAGTTCGCGTGCTGCT | 4835 |
| LbCas12a_NNK_814 | AAAACATCTTTAAGATCAACNNKGAAGTTCGCGTGCTGCTGAA | 4836 |
| LbCas12a_NNK_815 | ACATCTTTAAGATCAACACCNNKGTTCGCGTGCTGCTGAAACA | 4837 |
| LbCas12a_NNK_816 | TCTTTAAGATCAACACCGAANNKCGCGTGCTGCTGAAACATGA | 4838 |
| LbCas12a_NNK_817 | TTAAGATCAACACCGAAGTTNNKGTGCTGCTGAAACATGATGA | 4839 |
| LbCas12a_NNK_818 | AGATCAACACCGAAGTTCGCNNKCTGCTGAAACATGATGATAA | 4840 |
| LbCas12a_NNK_819 | TCAACACCGAAGTTCGCGTGNNKCTGAAACATGATGATAATCC | 4841 |
| LbCas12a_NNK_820 | ACACCGAAGTTCGCGTGCTGNNKAAACATGATGATAATCCGTA | 4842 |
| LbCas12a_NNK_821 | CCGAAGTTCGCGTGCTGCTGNNKCATGATGATAATCCGTATGT | 4843 |
| LbCas12a_NNK_822 | AAGTTCGCGTGCTGCTGAAANNKGATGATAATCCGTATGTGAT | 4844 |
| LbCas12a_NNK_823 | TTCGCGTGCTGCTGAAACATNNKGATAATCCGTATGTGATTGG | 4845 |
| LbCas12a_NNK_824 | GCGTGCTGCTGAAACATGATNNKAATCCGTATGTGATTGGCAT | 4846 |
| LbCas12a_NNK_825 | TGCTGCTGAAACATGATGATNNKCCGTATGTGATTGGCATTGA | 4847 |
| LbCas12a_NNK_826 | TGCTGAAACATGATGATAATNNKTATGTGATTGGCATTGATCG | 4848 |
| LbCas12a_NNK_827 | TGAAACATGATGATAATCCGNNKGTGATTGGCATTGATCGTGG | 4849 |
| LbCas12a_NNK_828 | AACATGATGATAATCCGTATNNKATTGGCATTGATCGTGGTGA | 4850 |
| LbCas12a_NNK_829 | ATGATGATAATCCGTATGTGNNKGGCATTGATCGTGGTGAACG | 4851 |
| LbCas12a_NNK_830 | ATGATAATCCGTATGTGATTNNKATTGATCGTGGTGAACGTAA | 4852 |
| LbCas12a_NNK_831 | ATAATCCGTATGTGATTGGCNNKGATCGTGGTGAACGTAACCT | 4853 |
| LbCas12a_NNK_832 | ATCCGTATGTGATTGGCATTNNKCGTGGTGAACGTAACCTGCT | 4854 |
| LbCas12a_NNK_833 | CGTATGTGATTGGCATTGATNNKGGTGAACGTAACCTGCTGTA | 4855 |
| LbCas12a_NNK_834 | ATGTGATTGGCATTGATCGTNNKGAACGTAACCTGCTGTATAT | 4856 |
| LbCas12a_NNK_835 | TGATTGGCATTGATCGTGGTNNKCGTAACCTGCTGTATATTGT | 4857 |
| LbCas12a_NNK_836 | TTGGCATTGATCGTGGTGAANNKAACCTGCTGTATATTGTTGT | 4858 |
| LbCas12a_NNK_837 | GCATTGATCGTGGTGAACGTNNKCTGCTGTATATTGTTGTTGT | 4859 |

TABLE 3-continued

Primers for creating LbCas12a Saturation Mutagenesis Library

| Name | Sequence (5'→3') | SEQ ID NO |
|---|---|---|
| LbCas12a_NNK_838 | TTGATCGTGGTGAACGTAACNNKCTGTATATTGTTGTTGTTGA | 4860 |
| LbCas12a_NNK_839 | ATCGTGGTGAACGTAACCTGNNKTATATTGTTGTTGTTGATGG | 4861 |
| LbCas12a_NNK_840 | GTGGTGAACGTAACCTGCTGNNKATTGTTGTTGTTGATGGTAA | 4862 |
| LbCas12a_NNK_841 | GTGAACGTAACCTGCTGTATNNKGTTGTTGTTGATGGTAAAGG | 4863 |
| LbCas12a_NNK_842 | AACGTAACCTGCTGTATATTNNKGTTGTTGATGGTAAAGGCAA | 4864 |
| LbCas12a_NNK_843 | GTAACCTGCTGTATATTGTTNNKGTTGATGGTAAAGGCAACAT | 4865 |
| LbCas12a_NNK_844 | ACCTGCTGTATATTGTTGTTNNKGATGGTAAAGGCAACATCGT | 4866 |
| LbCas12a_NNK_845 | TGCTGTATATTGTTGTTGTTNNKGGTAAAGGCAACATCGTGGA | 4867 |
| LbCas12a_NNK_846 | TGTATATTGTTGTTGTTGATNNKAAAGGCAACATCGTGGAACA | 4868 |
| LbCas12a_NNK_847 | ATATTGTTGTTGTTGATGGTNNKGGCAACATCGTGGAACAGTA | 4869 |
| LbCas12a_NNK_848 | TTGTTGTTGTTGATGGTAAANNKAACATCGTGGAACAGTATAG | 4870 |
| LbCas12a_NNK_849 | TTGTTGTTGATGGTAAAGGCNNKATCGTGGAACAGTATAGTCT | 4871 |
| LbCas12a_NNK_850 | TTGTTGATGGTAAAGGCAACNNKGTGGAACAGTATAGTCTGAA | 4872 |
| LbCas12a_NNK_851 | TTGATGGTAAAGGCAACATCNNKGAACAGTATAGTCTGAACGA | 4873 |
| LbCas12a_NNK_852 | ATGGTAAAGGCAACATCGTGNNKCAGTATAGTCTGAACGAAAT | 4874 |
| LbCas12a_NNK_853 | GTAAAGGCAACATCGTGGAANNKTATAGTCTGAACGAAATTAT | 4875 |
| LbCas12a_NNK_854 | AAGGCAACATCGTGGAACAGNNKAGTCTGAACGAAATTATCAA | 4876 |
| LbCas12a_NNK_855 | GCAACATCGTGGAACAGTATNNKCTGAACGAAATTATCAACAA | 4877 |
| LbCas12a_NNK_856 | ACATCGTGGAACAGTATAGTNNKAACGAAATTATCAACAACTT | 4878 |
| LbCas12a_NNK_857 | TCGTGGAACAGTATAGTCTGNNKGAAATTATCAACAACTTTAA | 4879 |
| LbCas12a_NNK_858 | TGGAACAGTATAGTCTGAACNNKATTATCAACAACTTTAACGG | 4880 |
| LbCas12a_NNK_859 | AACAGTATAGTCTGAACGAANNKATCAACAACTTTAACGGCAT | 4881 |
| LbCas12a_NNK_860 | AGTATAGTCTGAACGAAATTNNKAACAACTTTAACGGCATCCG | 4882 |
| LbCas12a_NNK_861 | ATAGTCTGAACGAAATTATCNNKAACTTTAACGGCATCCGCAT | 4883 |
| LbCas12a_NNK_862 | GTCTGAACGAAATTATCAACNNKTTTAACGGCATCCGCATCAA | 4884 |
| LbCas12a_NNK_863 | TGAACGAAATTATCAACAACNNKAACGGCATCCGCATCAAAAC | 4885 |
| LbCas12a_NNK_864 | ACGAAATTATCAACAACTTTNNKGGCATCCGCATCAAAACCGA | 4886 |
| LbCas12a_NNK_865 | AAATTATCAACAACTTTAACNNKATCCGCATCAAAACCGACTA | 4887 |
| LbCas12a_NNK_866 | TTATCAACAACTTTAACGGCNNKCGCATCAAAACCGACTATCA | 4888 |
| LbCas12a_NNK_867 | TCAACAACTTTAACGGCATCNNKATCAAAACCGACTATCATAG | 4889 |
| LbCas12a_NNK_868 | ACAACTTTAACGGCATCCGCNNKAAAACCGACTATCATAGCCT | 4890 |
| LbCas12a_NNK_869 | ACTTTAACGGCATCCGCATCNNKACCGACTATCATAGCCTGCT | 4891 |
| LbCas12a_NNK_870 | TTAACGGCATCCGCATCAAANNKGACTATCATAGCCTGCTGGA | 4892 |
| LbCas12a_NNK_871 | ACGGCATCCGCATCAAAACCNNKTATCATAGCCTGCTGGACAA | 4893 |
| LbCas12a_NNK_872 | GCATCCGCATCAAAACCGACNNKCATAGCCTGCTGGACAAGAA | 4894 |
| LbCas12a_NNK_873 | TCCGCATCAAAACCGACTATNNKAGCCTGCTGGACAAGAAAGA | 4895 |
| LbCas12a_NNK_874 | GCATCAAAACCGACTATCATNNKCTGCTGGACAAGAAAGAAAA | 4896 |

TABLE 3-continued

Primers for creating LbCas12a Saturation Mutagenesis Library

| Name | Sequence (5'→3') | SEQ ID NO |
|---|---|---|
| LbCas12a_NNK_875 | TCAAAACCGACTATCATAGCNNKCTGGACAAGAAAGAAAAGA | 4897 |
| LbCas12a_NNK_876 | AAACCGACTATCATAGCCTGNNKGACAAGAAAGAAAAGAACG | 4898 |
| LbCas12a_NNK_877 | CCGACTATCATAGCCTGCTGNNKAAGAAAGAAAAGAACGTTT | 4899 |
| LbCas12a_NNK_878 | ACTATCATAGCCTGCTGGACNNKAAAGAAAAAGAACGTTTTGA | 4900 |
| LbCas12a_NNK_879 | ATCATAGCCTGCTGGACAAGNNKGAAAAAGAACGTTTTGAAGC | 4901 |
| LbCas12a_NNK_880 | ATAGCCTGCTGGACAAGAAANNKAAAGAACGTTTTGAAGCACG | 4902 |
| LbCas12a_NNK_881 | GCCTGCTGGACAAGAAAGAANNKGAACGTTTTGAAGCACGTCA | 4903 |
| LbCas12a_NNK_882 | TGCTGGACAAGAAAGAAAAANNKCGTTTTGAAGCACGTCAGAA | 4904 |
| LbCas12a_NNK_883 | TGGACAAGAAAGAAAAAGAANNKTTTGAAGCACGTCAGAACTG | 4905 |
| LbCas12a_NNK_884 | ACAAGAAAGAAAAAGAACGTNNKGAAGCACGTCAGAACTGGAC | 4906 |
| LbCas12a_NNK_885 | AGAAAGAAAAGAACGTTTTNNKGCACGTCAGAACTGGACCAG | 4907 |
| LbCas12a_NNK_886 | AAGAAAAAGAACGTTTTGAANNKCGTCAGAACTGGACCAGTAT | 4908 |
| LbCas12a_NNK_887 | AAAAAGAACGTTTTGAAGCANNKCAGAACTGGACCAGTATTGA | 4909 |
| LbCas12a_NNK_888 | AAGAACGTTTTGAAGCACGTNNKAACTGGACCAGTATTGAAAA | 4910 |
| LbCas12a_NNK_889 | AACGTTTTGAAGCACGTCAGNNKTGGACCAGTATTGAAAACAT | 4911 |
| LbCas12a_NNK_890 | GTTTTGAAGCACGTCAGAACNNKACCAGTATTGAAAACATCAA | 4912 |
| LbCas12a_NNK_891 | TTGAAGCACGTCAGAACTGGNNKAGTATTGAAAACATCAAAGA | 4913 |
| LbCas12a_NNK_892 | AAGCACGTCAGAACTGGACCNNKATTGAAAACATCAAAGAACT | 4914 |
| LbCas12a_NNK_893 | CACGTCAGAACTGGACCAGTNNKGAAAACATCAAAGAACTGAA | 4915 |
| LbCas12a_NNK_894 | GTCAGAACTGGACCAGTATTNNKAACATCAAAGAACTGAAAGC | 4916 |
| LbCas12a_NNK_895 | AGAACTGGACCAGTATTGAANNKATCAAAGAACTGAAAGCCGG | 4917 |
| LbCas12a_NNK_896 | ACTGGACCAGTATTGAAAACNNKAAAGAACTGAAAGCCGGTTA | 4918 |
| LbCas12a_NNK_897 | GGACCAGTATTGAAAACATCNNKGAACTGAAAGCCGGTTATAT | 4919 |
| LbCas12a_NNK_898 | CCAGTATTGAAAACATCAAANNKCTGAAAGCCGGTTATATTAG | 4920 |
| LbCas12a_NNK_899 | GTATTGAAAACATCAAAGAANNKAAAGCCGGTTATATTAGCCA | 4921 |
| LbCas12a_NNK_900 | TTGAAAACATCAAAGAACTGNNKGCCGGTTATATTAGCCAGGT | 4922 |
| LbCas12a_NNK_901 | AAAACATCAAAGAACTGAAANNKGGTTATATTAGCCAGGTGGT | 4923 |
| LbCas12a_NNK_902 | ACATCAAAGAACTGAAAGCCNNKTATATTAGCCAGGTGGTTCA | 4924 |
| LbCas12a_NNK_903 | TCAAAGAACTGAAAGCCGGTNNKATTAGCCAGGTGGTTCATAA | 4925 |
| LbCas12a_NNK_904 | AAGAACTGAAAGCCGGTTATNNKAGCCAGGTGGTTCATAAAAT | 4926 |
| LbCas12a_NNK_905 | AACTGAAAGCCGGTTATATTNNKCAGGTGGTTCATAAAATCTG | 4927 |
| LbCas12a_NNK_906 | TGAAAGCCGGTTATATTAGCNNKGTGGTTCATAAAATCTGTGA | 4928 |
| LbCas12a_NNK_907 | AAGCCGGTTATATTAGCCAGNNKGTTCATAAAATCTGTGAGCT | 4929 |
| LbCas12a_NNK_908 | CCGGTTATATTAGCCAGGTGNNKCATAAAATCTGTGAGCTGGT | 4930 |
| LbCas12a_NNK_909 | GTTATATTAGCCAGGTGGTTNNKAAAATCTGTGAGCTGGTAGA | 4931 |
| LbCas12a_NNK_910 | ATATTAGCCAGGTGGTTCATNNKATCTGTGAGCTGGTAGAAAA | 4932 |
| LbCas12a_NNK_911 | TTAGCCAGGTGGTTCATAAANNKTGTGAGCTGGTAGAAAAATA | 4933 |
| LbCas12a_NNK_912 | GCCAGGTGGTTCATAAAATCNNKGAGCTGGTAGAAAAATACGA | 4934 |

TABLE 3-continued

Primers for creating LbCas12a Saturation Mutagenesis Library

| Name | Sequence (5'→3') | SEQ ID NO |
|---|---|---|
| LbCas12a_NNK_913 | AGGTGGTTCATAAAATCTGTNNKCTGGTAGAAAAATACGATGC | 4935 |
| LbCas12a_NNK_914 | TGGTTCATAAAATCTGTGAGNNKGTAGAAAAATACGATGCAGT | 4936 |
| LbCas12a_NNK_915 | TTCATAAAATCTGTGAGCTGNNKGAAAAATACGATGCAGTTAT | 4937 |
| LbCas12a_NNK_916 | ATAAAATCTGTGAGCTGGTANNKAAATACGATGCAGTTATTGC | 4938 |
| LbCas12a_NNK_917 | AAATCTGTGAGCTGGTAGAANNKTACGATGCAGTTATTGCACT | 4939 |
| LbCas12a_NNK_918 | TCTGTGAGCTGGTAGAAAAANNKGATGCAGTTATTGCACTGGA | 4940 |
| LbCas12a_NNK_919 | GTGAGCTGGTAGAAAAATACNNKGCAGTTATTGCACTGGAAGA | 4941 |
| LbCas12a_NNK_920 | AGCTGGTAGAAAAATACGATNNKGTTATTGCACTGGAAGATCT | 4942 |
| LbCas12a_NNK_921 | TGGTAGAAAAATACGATGCANNKATTGCACTGGAAGATCTGAA | 4943 |
| LbCas12a_NNK_922 | TAGAAAAATACGATGCAGTTNNKGCACTGGAAGATCTGAATAG | 4944 |
| LbCas12a_NNK_923 | AAAAATACGATGCAGTTATTNNKCTGGAAGATCTGAATAGCGG | 4945 |
| LbCas12a_NNK_924 | AATACGATGCAGTTATTGCANNKGAAGATCTGAATAGCGGTTT | 4946 |
| LbCas12a_NNK_925 | ACGATGCAGTTATTGCACTGNNKGATCTGAATAGCGGTTTCAA | 4947 |
| LbCas12a_NNK_926 | ATGCAGTTATTGCACTGGAANNKCTGAATAGCGGTTTCAAAAA | 4948 |
| LbCas12a_NNK_927 | CAGTTATTGCACTGGAAGATNNKAATAGCGGTTTCAAAAATAG | 4949 |
| LbCas12a_NNK_928 | TTATTGCACTGGAAGATCTGNNKAGCGGTTTCAAAAATAGCCG | 4950 |
| LbCas12a_NNK_929 | TTGCACTGGAAGATCTGAATNNKGGTTTCAAAAATAGCCGTGT | 4951 |
| LbCas12a_NNK_930 | CACTGGAAGATCTGAATAGCNNKTTCAAAAATAGCCGTGTGAA | 4952 |
| LbCas12a_NNK_931 | TGGAAGATCTGAATAGCGGTNNKAAAAATAGCCGTGTGAAAGT | 4953 |
| LbCas12a_NNK_932 | AAGATCTGAATAGCGGTTTCNNKAATAGCCGTGTGAAAGTCGA | 4954 |
| LbCas12a_NNK_933 | ATCTGAATAGCGGTTTCAAANNKAGCCGTGTGAAAGTCGAAAA | 4955 |
| LbCas12a_NNK_934 | TGAATAGCGGTTTCAAAAATNNKCGTGTGAAAGTCGAAAACA | 4956 |
| LbCas12a_NNK_935 | ATAGCGGTTTCAAAAATAGCNNKGTGAAAGTCGAAAAACAGGT | 4957 |
| LbCas12a_NNK_936 | GCGGTTTCAAAAATAGCCGTNNKAAAGTCGAAAAACAGGTGTA | 4958 |
| LbCas12a_NNK_937 | GTTTCAAAAATAGCCGTGTGNNKGTCGAAAAACAGGTGTATCA | 4959 |
| LbCas12a_NNK_938 | TCAAAAATAGCCGTGTGAAANNKGAAAAACAGGTGTATCAGAA | 4960 |
| LbCas12a_NNK_939 | AAAATAGCCGTGTGAAAGTCNNKAAACAGGTGTATCAGAAATT | 4961 |
| LbCas12a_NNK_940 | ATAGCCGTGTGAAAGTCGAANNKCAGGTGTATCAGAAATTCGA | 4962 |
| LbCas12a_NNK_941 | GCCGTGTGAAAGTCGAAAAANNKGTGTATCAGAAATTCGAGAA | 4963 |
| LbCas12a_NNK_942 | GTGTGAAAGTCGAAAAACAGNNKTATCAGAAATTCGAGAAAAT | 4964 |
| LbCas12a_NNK_943 | TGAAAGTCGAAAAACAGGTGNNKCAGAAATTCGAGAAAATGCT | 4965 |
| LbCas12a_NNK_944 | AAGTCGAAAAACAGGTGTATNNKAAATTCGAGAAAATGCTGAT | 4966 |
| LbCas12a_NNK_945 | TCGAAAAACAGGTGTATCAGNNKTTCGAGAAAATGCTGATCGA | 4967 |
| LbCas12a_NNK_946 | AAAAACAGGTGTATCAGAAANNKGAGAAAATGCTGATCGACAA | 4968 |
| LbCas12a_NNK_947 | AACAGGTGTATCAGAAATTCNNKAAAATGCTGATCGACAAACT | 4969 |
| LbCas12a_NNK_948 | AGGTGTATCAGAAATTCGAGNNKATGCTGATCGACAAACTGAA | 4970 |
| LbCas12a_NNK_949 | TGTATCAGAAATTCGAGAAANNKCTGATCGACAAACTGAACTA | 4971 |

TABLE 3-continued

Primers for creating LbCas12a Saturation Mutagenesis Library

| Name | Sequence (5'→3') | SEQ ID NO |
|---|---|---|
| LbCas12a_NNK_950 | ATCAGAAATTCGAGAAAATGNNKATCGACAAACTGAACTACAT | 4972 |
| LbCas12a_NNK_951 | AGAAATTCGAGAAAATGCTGNNKGACAAACTGAACTACATGGT | 4973 |
| LbCas12a_NNK_952 | AATTCGAGAAAATGCTGATCNNKAAACTGAACTACATGGTCGA | 4974 |
| LbCas12a_NNK_953 | TCGAGAAAATGCTGATCGACNNKCTGAACTACATGGTCGACAA | 4975 |
| LbCas12a_NNK_954 | AGAAAATGCTGATCGACAAANNKAACTACATGGTCGACAAAAA | 4976 |
| LbCas12a_NNK_955 | AAATGCTGATCGACAAACTGNNKTACATGGTCGACAAAAAAAG | 4977 |
| LbCas12a_NNK_956 | TGCTGATCGACAAACTGAACNNKATGGTCGACAAAAAAAGCAA | 4978 |
| LbCas12a_NNK_957 | TGATCGACAAACTGAACTACNNKGTCGACAAAAAAAGCAATCC | 4979 |
| LbCas12a_NNK_958 | TCGACAAACTGAACTACATGNNKGACAAAAAAAGCAATCCGTG | 4980 |
| LbCas12a_NNK_959 | ACAAACTGAACTACATGGTCNNKAAAAAAAGCAATCCGTGTGC | 4981 |
| LbCas12a_NNK_960 | AACTGAACTACATGGTCGACNNKAAAAGCAATCCGTGTGCAAC | 4982 |
| LbCas12a_NNK_961 | TGAACTACATGGTCGACAAANNKAGCAATCCGTGTGCAACCGG | 4983 |
| LbCas12a_NNK_962 | ACTACATGGTCGACAAAAAANNKAATCCGTGTGCAACCGGTGG | 4984 |
| LbCas12a_NNK_963 | ACATGGTCGACAAAAAAGCNNKCCGTGTGCAACCGGTGGTGC | 4985 |
| LbCas12a_NNK_964 | TGGTCGACAAAAAAGCAATNNKTGTGCAACCGGTGGTGCACT | 4986 |
| LbCas12a_NNK_965 | TCGACAAAAAAGCAATCCGNNKGCAACCGGTGGTGCACTGAA | 4987 |
| LbCas12a_NNK_966 | ACAAAAAAGCAATCCGTGTNNKACCGGTGGTGCACTGAAAGG | 4988 |
| LbCas12a_NNK_967 | AAAAAGCAATCCGTGTGCANNKGGTGGTGCACTGAAAGGTTA | 4989 |
| LbCas12a_NNK_968 | AAAGCAATCCGTGTGCAACCNNKGGTGCACTGAAAGGTTATCA | 4990 |
| LbCas12a_NNK_969 | GCAATCCGTGTGCAACCGGTNNKGCACTGAAAGGTTATCAGAT | 4991 |
| LbCas12a_NNK_970 | ATCCGTGTGCAACCGGTGGTNNKCTGAAAGGTTATCAGATTAC | 4992 |
| LbCas12a_NNK_971 | CGTGTGCAACCGGTGGTGCANNKAAAGGTTATCAGATTACCAA | 4993 |
| LbCas12a_NNK_972 | GTGCAACCGGTGGTGCACTGNNKGGTTATCAGATTACCAACAA | 4994 |
| LbCas12a_NNK_973 | CAACCGGTGGTGCACTGAAANNKTATCAGATTACCAACAAATT | 4995 |
| LbCas12a_NNK_974 | CCGGTGGTGCACTGAAAGGTNNKCAGATTACCAACAAATTTGA | 4996 |
| LbCas12a_NNK_975 | GTGGTGCACTGAAAGGTTATNNKATTACCAACAAATTTGAAAG | 4997 |
| LbCas12a_NNK_976 | GTGCACTGAAAGGTTATCAGNNKACCAACAAATTTGAAAGCTT | 4998 |
| LbCas12a_NNK_977 | CACTGAAAGGTTATCAGATTNNKAACAAATTTGAAAGCTTTAA | 4999 |
| LbCas12a_NNK_978 | TGAAAGGTTATCAGATTACCNNKAAATTTGAAAGCTTTAAAAG | 5000 |
| LbCas12a_NNK_979 | AAGGTTATCAGATTACCAACNNKTTTGAAAGCTTTAAAAGCAT | 5001 |
| LbCas12a_NNK_980 | GTTATCAGATTACCAACAAANNKGAAAGCTTTAAAAGCATGAG | 5002 |
| LbCas12a_NNK_981 | ATCAGATTACCAACAAATTTNNKAGCTTTAAAAGCATGAGCAC | 5003 |
| LbCas12a_NNK_982 | AGATTACCAACAAATTTGAANNKTTTAAAAGCATGAGCACCCA | 5004 |
| LbCas12a_NNK_983 | TTACCAACAAATTTGAAAGCNNKAAAAGCATGAGCACCCAGAA | 5005 |
| LbCas12a_NNK_984 | CCAACAAATTTGAAAGCTTTNNKAGCATGAGCACCCAGAACGG | 5006 |
| LbCas12a_NNK_985 | ACAAATTTGAAAGCTTTAAANNKATGAGCACCCAGAACGGCTT | 5007 |
| LbCas12a_NNK_986 | AATTTGAAAGCTTTAAAAGCNNKAGCACCCAGAACGGCTTTAT | 5008 |
| LbCas12a_NNK_987 | TTGAAAGCTTTAAAAGCATGNNKACCCAGAACGGCTTTATCTT | 5009 |

TABLE 3-continued

Primers for creating LbCas12a Saturation Mutagenesis Library

| Name | Sequence (5'→3') | SEQ ID NO |
|---|---|---|
| LbCas12a_NNK_988 | AAAGCTTTAAAAGCATGAGCNNKCAGAACGGCTTTATCTTCTA | 5010 |
| LbCas12a_NNK_989 | GCTTTAAAAGCATGAGCACCNNKAACGGCTTTATCTTCTATAT | 5011 |
| LbCas12a_NNK_990 | TTAAAAGCATGAGCACCCAGNNKGGCTTTATCTTCTATATTCC | 5012 |
| LbCas12a_NNK_991 | AAAGCATGAGCACCCAGAACNNKTTTATCTTCTATATTCCGGC | 5013 |
| LbCas12a_NNK_992 | GCATGAGCACCCAGAACGGCNNKATCTTCTATATTCCGGCATG | 5014 |
| LbCas12a_NNK_993 | TGAGCACCCAGAACGGCTTTNNKTTCTATATTCCGGCATGGCT | 5015 |
| LbCas12a_NNK_994 | GCACCCAGAACGGCTTTATCNNKTATATTCCGGCATGGCTGAC | 5016 |
| LbCas12a_NNK_995 | CCCAGAACGGCTTTATCTTCNNKATTCCGGCATGGCTGACCAG | 5017 |
| LbCas12a_NNK_996 | AGAACGGCTTTATCTTCTATNNKCCGGCATGGCTGACCAGCAA | 5018 |
| LbCas12a_NNK_997 | ACGGCTTTATCTTCTATATTNNKGCATGGCTGACCAGCAAAAT | 5019 |
| LbCas12a_NNK_998 | GCTTTATCTTCTATATTCCGNNKTGGCTGACCAGCAAAATTGA | 5020 |
| LbCas12a_NNK_999 | TTATCTTCTATATTCCGGCANNKCTGACCAGCAAAATTGATCC | 5021 |
| LbCas12a_NNK_1000 | TCTTCTATATTCCGGCATGGNNKACCAGCAAAATTGATCCGAG | 5022 |
| LbCas12a_NNK_1001 | TCTATATTCCGGCATGGCTGNNKAGCAAAATTGATCCGAGCAC | 5023 |
| LbCas12a_NNK_1002 | ATATTCCGGCATGGCTGACCNNKAAAATTGATCCGAGCACCGG | 5024 |
| LbCas12a_NNK_1003 | TTCCGGCATGGCTGACCAGCNNKATTGATCCGAGCACCGGTTT | 5025 |
| LbCas12a_NNK_1004 | CGGCATGGCTGACCAGCAAANNKGATCCGAGCACCGGTTTTGT | 5026 |
| LbCas12a_NNK_1005 | CATGGCTGACCAGCAAAATTNNKCCGAGCACCGGTTTTGTGAA | 5027 |
| LbCas12a_NNK_1006 | GGCTGACCAGCAAAATTGATNNKAGCACCGGTTTTGTGAACCT | 5028 |
| LbCas12a_NNK_1007 | TGACCAGCAAAATTGATCCGNNKACCGGTTTTGTGAACCTGCT | 5029 |
| LbCas12a_NNK_1008 | CCAGCAAAATTGATCCGAGCNNKGGTTTTGTGAACCTGCTGAA | 5030 |
| LbCas12a_NNK_1009 | GCAAAATTGATCCGAGCACCNNKTTTGTGAACCTGCTGAAAAC | 5031 |
| LbCas12a_NNK_1010 | AAATTGATCCGAGCACCGGTNNKGTGAACCTGCTGAAAACAAA | 5032 |
| LbCas12a_NNK_1011 | TTGATCCGAGCACCGGTTTTNNKAACCTGCTGAAAACAAAATA | 5033 |
| LbCas12a_NNK_1012 | ATCCGAGCACCGGTTTTGTGNNKCTGCTGAAAACAAAATATAC | 5034 |
| LbCas12a_NNK_1013 | CGAGCACCGGTTTTGTGAACNNKCTGAAAACAAAATATACCTC | 5035 |
| LbCas12a_NNK_1014 | GCACCGGTTTTGTGAACCTGNNKAAAACAAAATATACCTCCAT | 5036 |
| LbCas12a_NNK_1015 | CCGGTTTTGTGAACCTGCTGNNKACAAAATATACCTCCATTGC | 5037 |
| LbCas12a_NNK_1016 | GTTTTGTGAACCTGCTGAAANNKAAATATACCTCCATTGCCGA | 5038 |
| LbCas12a_NNK_1017 | TTGTGAACCTGCTGAAAACANNKTATACCTCCATTGCCGACAG | 5039 |
| LbCas12a_NNK_1018 | TGAACCTGCTGAAAACAAAANNKACCTCCATTGCCGACAGCAA | 5040 |
| LbCas12a_NNK_1019 | ACCTGCTGAAAACAAAATATNNKTCCATTGCCGACAGCAAGAA | 5041 |
| LbCas12a_NNK_1020 | TGCTGAAAACAAAATATACCNNKATTGCCGACAGCAAGAAGTT | 5042 |
| LbCas12a_NNK_1021 | TGAAAACAAAATATACCTCCNNKGCCGACAGCAAGAAGTTTAT | 5043 |
| LbCas12a_NNK_1022 | AAACAAAATATACCTCCATTNNKGACAGCAAGAAGTTTATTAG | 5044 |
| LbCas12a_NNK_1023 | CAAAATATACCTCCATTGCCNNKAGCAAGAAGTTTATTAGCAG | 5045 |
| LbCas12a_NNK_1024 | AATATACCTCCATTGCCGACNNKAAGAAGTTTATTAGCAGCTT | 5046 |

TABLE 3-continued

Primers for creating LbCas12a Saturation Mutagenesis Library

| Name | Sequence (5'→3') | SEQ ID NO |
|---|---|---|
| LbCas12a_NNK_1025 | ATACCTCCATTGCCGACAGCNNKAAGTTTATTAGCAGCTTTGA | 5047 |
| LbCas12a_NNK_1026 | CCTCCATTGCCGACAGCAAGNNKTTTATTAGCAGCTTTGATCG | 5048 |
| LbCas12a_NNK_1027 | CCATTGCCGACAGCAAGAAGNNKATTAGCAGCTTTGATCGCAT | 5049 |
| LbCas12a_NNK_1028 | TTGCCGACAGCAAGAAGTTTNNKAGCAGCTTTGATCGCATTAT | 5050 |
| LbCas12a_NNK_1029 | CCGACAGCAAGAAGTTTATTNNKAGCTTTGATCGCATTATGTA | 5051 |
| LbCas12a_NNK_1030 | ACAGCAAGAAGTTTATTAGCNNKTTTGATCGCATTATGTATGT | 5052 |
| LbCas12a_NNK_1031 | GCAAGAAGTTTATTAGCAGCNNKGATCGCATTATGTATGTTCC | 5053 |
| LbCas12a_NNK_1032 | AGAAGTTTATTAGCAGCTTTNNKCGCATTATGTATGTTCCGGA | 5054 |
| LbCas12a_NNK_1033 | AGTTTATTAGCAGCTTTGATNNKATTATGTATGTTCCGGAAGA | 5055 |
| LbCas12a_NNK_1034 | TTATTAGCAGCTTTGATCGCNNKATGTATGTTCCGGAAGAGGA | 5056 |
| LbCas12a_NNK_1035 | TTAGCAGCTTTGATCGCATTNNKTATGTTCCGGAAGAGGACCT | 5057 |
| LbCas12a_NNK_1036 | GCAGCTTTGATCGCATTATGNNKGTTCCGGAAGAGGACCTGTT | 5058 |
| LbCas12a_NNK_1037 | GCTTTGATCGCATTATGTATNNKCCGGAAGAGGACCTGTTTGA | 5059 |
| LbCas12a_NNK_1038 | TTGATCGCATTATGTATGTTNNKGAAGAGGACCTGTTTGAATT | 5060 |
| LbCas12a_NNK_1039 | ATCGCATTATGTATGTTCCGNNKGAGGACCTGTTTGAATTCGC | 5061 |
| LbCas12a_NNK_1040 | GCATTATGTATGTTCCGGAANNKGACCTGTTTGAATTCGCACT | 5062 |
| LbCas12a_NNK_1041 | TTATGTATGTTCCGGAAGAGNNKCTGTTTGAATTCGCACTGGA | 5063 |
| LbCas12a_NNK_1042 | TGTATGTTCCGGAAGAGGACNNKTTTGAATTCGCACTGGATTA | 5064 |
| LbCas12a_NNK_1043 | ATGTTCCGGAAGAGGACCTGNNKGAATTCGCACTGGATTACAA | 5065 |
| LbCas12a_NNK_1044 | TTCCGGAAGAGGACCTGTTTNNKTTCGCACTGGATTACAAAAA | 5066 |
| LbCas12a_NNK_1045 | CGGAAGAGGACCTGTTTGAANNKGCACTGGATTACAAAAATTT | 5067 |
| LbCas12a_NNK_1046 | AAGAGGACCTGTTTGAATTCNNKCTGGATTACAAAAATTTCAG | 5068 |
| LbCas12a_NNK_1047 | AGGACCTGTTTGAATTCGCANNKGATTACAAAAATTTCAGCCG | 5069 |
| LbCas12a_NNK_1048 | ACCTGTTTGAATTCGCACTGNNKTACAAAAATTTCAGCCGTAC | 5070 |
| LbCas12a_NNK_1049 | TGTTTGAATTCGCACTGGATNNKAAAAATTTCAGCCGTACCGA | 5071 |
| LbCas12a_NNK_1050 | TTGAATTCGCACTGGATTACNNKAATTTCAGCCGTACCGATGC | 5072 |
| LbCas12a_NNK_1051 | AATTCGCACTGGATTACAAANNKTTCAGCCGTACCGATGCCGA | 5073 |
| LbCas12a_NNK_1052 | TCGCACTGGATTACAAAAATNNKAGCCGTACCGATGCCGACTA | 5074 |
| LbCas12a_NNK_1053 | CACTGGATTACAAAAATTTCNNKCGTACCGATGCCGACTACAT | 5075 |
| LbCas12a_NNK_1054 | TGGATTACAAAAATTTCAGCNNKACCGATGCCGACTACATCAA | 5076 |
| LbCas12a_NNK_1055 | ATTACAAAAATTTCAGCCGTNNKGATGCCGACTACATCAAAAA | 5077 |
| LbCas12a_NNK_1056 | ACAAAAATTTCAGCCGTACCNNKGCCGACTACATCAAAAAATG | 5078 |
| LbCas12a_NNK_1057 | AAAATTTCAGCCGTACCGATNNKGACTACATCAAAAAATGGAA | 5079 |
| LbCas12a_NNK_1058 | ATTTCAGCCGTACCGATGCCNNKTACATCAAAAAATGGAAACT | 5080 |
| LbCas12a_NNK_1059 | TCAGCCGTACCGATGCCGACNNKATCAAAAAATGGAAACTGTA | 5081 |
| LbCas12a_NNK_1060 | GCCGTACCGATGCCGACTACNNKAAAAAATGGAAACTGTACAG | 5082 |
| LbCas12a_NNK_1061 | GTACCGATGCCGACTACATCNNKAAATGGAAACTGTACAGCTA | 5083 |
| LbCas12a_NNK_1062 | CCGATGCCGACTACATCAAANNKTGGAAACTGTACAGCTATGG | 5084 |

TABLE 3-continued

Primers for creating LbCas12a Saturation Mutagenesis Library

| Name | Sequence (5'→3') | SEQ ID NO |
|---|---|---|
| LbCas12a_NNK_1063 | ATGCCGACTACATCAAAAAANNKAAACTGTACAGCTATGGTAA | 5085 |
| LbCas12a_NNK_1064 | CCGACTACATCAAAAAATGNNKCTGTACAGCTATGGTAACCG | 5086 |
| LbCas12a_NNK_1065 | ACTACATCAAAAAATGGAAANNKTACAGCTATGGTAACCGCAT | 5087 |
| LbCas12a_NNK_1066 | ACATCAAAAAATGGAAACTGNNKAGCTATGGTAACCGCATTCG | 5088 |
| LbCas12a_NNK_1067 | TCAAAAAATGGAAACTGTACNNKTATGGTAACCGCATTCGCAT | 5089 |
| LbCas12a_NNK_1068 | AAAAATGGAAACTGTACAGCNNKGGTAACCGCATTCGCATTTT | 5090 |
| LbCas12a_NNK_1069 | AATGGAAACTGTACAGCTATNNKAACCGCATTCGCATTTTTCG | 5091 |
| LbCas12a_NNK_1070 | GGAAACTGTACAGCTATGGTNNKCGCATTCGCATTTTTCGCAA | 5092 |
| LbCas12a_NNK_1071 | AACTGTACAGCTATGGTAACNNKATTCGCATTTTTCGCAACCC | 5093 |
| LbCas12a_NNK_1072 | TGTACAGCTATGGTAACCGCNNKCGCATTTTTCGCAACCCGAA | 5094 |
| LbCas12a_NNK_1073 | ACAGCTATGGTAACCGCATTNNKATTTTTCGCAACCCGAAGAA | 5095 |
| LbCas12a_NNK_1074 | GCTATGGTAACCGCATTCGCNNKTTTCGCAACCCGAAGAAAAA | 5096 |
| LbCas12a_NNK_1075 | ATGGTAACCGCATTCGCATTNNKCGCAACCCGAAGAAAAACAA | 5097 |
| LbCas12a_NNK_1076 | GTAACCGCATTCGCATTTTTNNKAACCCGAAGAAAAACAATGT | 5098 |
| LbCas12a_NNK_1077 | ACCGCATTCGCATTTTTCGCNNKCCGAAGAAAAACAATGTGTT | 5099 |
| LbCas12a_NNK_1078 | GCATTCGCATTTTTCGCAACNNKAAGAAAAACAATGTGTTCGA | 5100 |
| LbCas12a_NNK_1079 | TTCGCATTTTTCGCAACCCGNNKAAAAACAATGTGTTCGATTG | 5101 |
| LbCas12a_NNK_1080 | GCATTTTTCGCAACCCGAAGNNKAACAATGTGTTCGATTGGGA | 5102 |
| LbCas12a_NNK_1081 | TTTTTCGCAACCCGAAGAAANNKAATGTGTTCGATTGGGAAGA | 5103 |
| LbCas12a_NNK_1082 | TTCGCAACCCGAAGAAAAACNNKGTGTTCGATTGGGAAGAAGT | 5104 |
| LbCas12a_NNK_1083 | GCAACCCGAAGAAAAACAATNNKTTCGATTGGGAAGAAGTTTG | 5105 |
| LbCas12a_NNK_1084 | ACCCGAAGAAAAACAATGTGNNKGATTGGGAAGAAGTTTGTCT | 5106 |
| LbCas12a_NNK_1085 | CGAAGAAAAACAATGTGTTCNNKTGGGAAGAAGTTTGTCTGAC | 5107 |
| LbCas12a_NNK_1086 | AGAAAAACAATGTGTTCGATNNKGAAGAAGTTTGTCTGACCAG | 5108 |
| LbCas12a_NNK_1087 | AAAACAATGTGTTCGATTGGNNKGAAGTTTGTCTGACCAGCGC | 5109 |
| LbCas12a_NNK_1088 | ACAATGTGTTCGATTGGGAANNKGTTTGTCTGACCAGCGCATA | 5110 |
| LbCas12a_NNK_1089 | ATGTGTTCGATTGGGAAGAANNKTGTCTGACCAGCGCATATAA | 5111 |
| LbCas12a_NNK_1090 | TGTTCGATTGGGAAGAAGTTNNKCTGACCAGCGCATATAAAGA | 5112 |
| LbCas12a_NNK_1091 | TCGATTGGGAAGAAGTTTGTNNKACCAGCGCATATAAAGAACT | 5113 |
| LbCas12a_NNK_1092 | ATTGGGAAGAAGTTTGTCTGNNKAGCGCATATAAAGAACTTTT | 5114 |
| LbCas12a_NNK_1093 | GGGAAGAAGTTTGTCTGACCNNKGCATATAAAGAACTTTTCAA | 5115 |
| LbCas12a_NNK_1094 | AAGAAGTTTGTCTGACCAGCNNKTATAAAGAACTTTTCAACAA | 5116 |
| LbCas12a_NNK_1095 | AAGTTTGTCTGACCAGCGCANNKAAAGAACTTTTCAACAAATA | 5117 |
| LbCas12a_NNK_1096 | TTTGTCTGACCAGCGCATATNNKGAACTTTTCAACAAATACGG | 5118 |
| LbCas12a_NNK_1097 | GTCTGACCAGCGCATATAAANNKCTTTTCAACAAATACGGCAT | 5119 |
| LbCas12a_NNK_1098 | TGACCAGCGCATATAAAGAANNKTTCAACAAATACGGCATCAA | 5120 |
| LbCas12a_NNK_1099 | CCAGCGCATATAAAGAACTTNNKAACAAATACGGCATCAACTA | 5121 |

TABLE 3-continued

Primers for creating LbCas12a Saturation Mutagenesis Library

| Name | Sequence (5'→3') | SEQ ID NO |
|---|---|---|
| LbCas12a_NNK_1100 | GCGCATATAAAGAACTTTTCNNKAAATACGGCATCAACTATCA | 5122 |
| LbCas12a_NNK_1101 | CATATAAAGAACTTTTCAACNNKTACGGCATCAACTATCAGCA | 5123 |
| LbCas12a_NNK_1102 | ATAAAGAACTTTTCAACAAANNKGGCATCAACTATCAGCAGGG | 5124 |
| LbCas12a_NNK_1103 | AAGAACTTTTCAACAAATACNNKATCAACTATCAGCAGGGTGA | 5125 |
| LbCas12a_NNK_1104 | AACTTTTCAACAAATACGGCNNKAACTATCAGCAGGGTGATAT | 5126 |
| LbCas12a_NNK_1105 | TTTTCAACAAATACGGCATCNNKTATCAGCAGGGTGATATTCG | 5127 |
| LbCas12a_NNK_1106 | TCAACAAATACGGCATCAACNNKCAGCAGGGTGATATTCGTGC | 5128 |
| LbCas12a_NNK_1107 | ACAAATACGGCATCAACTATNNKCAGGGTGATATTCGTGCACT | 5129 |
| LbCas12a_NNK_1108 | AATACGGCATCAACTATCAGNNKGGTGATATTCGTGCACTGCT | 5130 |
| LbCas12a_NNK_1109 | ACGGCATCAACTATCAGCAGNNKGATATTCGTGCACTGCTGTG | 5131 |
| LbCas12a_NNK_1110 | GCATCAACTATCAGCAGGGTNNKATTCGTGCACTGCTGTGTGA | 5132 |
| LbCas12a_NNK_1111 | TCAACTATCAGCAGGGTGATNNKCGTGCACTGCTGTGTGAACA | 5133 |
| LbCas12a_NNK_1112 | ACTATCAGCAGGGTGATATTNNKGCACTGCTGTGTGAACAGAG | 5134 |
| LbCas12a_NNK_1113 | ATCAGCAGGGTGATATTCGTNNKCTGCTGTGTGAACAGAGCGA | 5135 |
| LbCas12a_NNK_1114 | AGCAGGGTGATATTCGTGCANNKCTGTGTGAACAGAGCGATAA | 5136 |
| LbCas12a_NNK_1115 | AGGGTGATATTCGTGCACTGNNKTGTGAACAGAGCGATAAAGC | 5137 |
| LbCas12a_NNK_1116 | GTGATATTCGTGCACTGCTGNNKGAACAGAGCGATAAAGCGTT | 5138 |
| LbCas12a_NNK_1117 | ATATTCGTGCACTGCTGTGTNNKCAGAGCGATAAAGCGTTTTA | 5139 |
| LbCas12a_NNK_1118 | TTCGTGCACTGCTGTGTGAANNKAGCGATAAAGCGTTTTATAG | 5140 |
| LbCas12a_NNK_1119 | GTGCACTGCTGTGTGAACAGNNKGATAAAGCGTTTTATAGCAG | 5141 |
| LbCas12a_NNK_1120 | CACTGCTGTGTGAACAGAGCNNKAAAGCGTTTTATAGCAGTTT | 5142 |
| LbCas12a_NNK_1121 | TGCTGTGTGAACAGAGCGATNNKGCGTTTTATAGCAGTTTTAT | 5143 |
| LbCas12a_NNK_1122 | TGTGTGAACAGAGCGATAAANNKTTTTATAGCAGTTTTATGGC | 5144 |
| LbCas12a_NNK_1123 | GTGAACAGAGCGATAAAGCGNNKTATAGCAGTTTTATGGCACT | 5145 |
| LbCas12a_NNK_1124 | AACAGAGCGATAAAGCGTTTNNKAGCAGTTTTATGGCACTGAT | 5146 |
| LbCas12a_NNK_1125 | AGAGCGATAAAGCGTTTTATNNKAGTTTTATGGCACTGATGAG | 5147 |
| LbCas12a_NNK_1126 | GCGATAAAGCGTTTTATAGCNNKTTTATGGCACTGATGAGCCT | 5148 |
| LbCas12a_NNK_1127 | ATAAAGCGTTTTATAGCAGTNNKATGGCACTGATGAGCCTGAT | 5149 |
| LbCas12a_NNK_1128 | AAGCGTTTTATAGCAGTTTTNNKGCACTGATGAGCCTGATGCT | 5150 |
| LbCas12a_NNK_1129 | CGTTTTATAGCAGTTTTATGNNKCTGATGAGCCTGATGCTGCA | 5151 |
| LbCas12a_NNK_1130 | TTTATAGCAGTTTTATGGCANNKATGAGCCTGATGCTGCAGAT | 5152 |
| LbCas12a_NNK_1131 | ATAGCAGTTTTATGGCACTGNNKAGCCTGATGCTGCAGATGCG | 5153 |
| LbCas12a_NNK_1132 | GCAGTTTTATGGCACTGATGNNKCTGATGCTGCAGATGCGTAA | 5154 |
| LbCas12a_NNK_1133 | GTTTTATGGCACTGATGAGCNNKATGCTGCAGATGCGTAATAG | 5155 |
| LbCas12a_NNK_1134 | TTATGGCACTGATGAGCCTGNNKCTGCAGATGCGTAATAGCAT | 5156 |
| LbCas12a_NNK_1135 | TGGCACTGATGAGCCTGATGNNKCAGATGCGTAATAGCATTAC | 5157 |
| LbCas12a_NNK_1136 | CACTGATGAGCCTGATGCTGNNKATGCGTAATAGCATTACCGG | 5158 |
| LbCas12a_NNK_1137 | TGATGAGCCTGATGCTGCAGNNKCGTAATAGCATTACCGGTCG | 5159 |

TABLE 3-continued

Primers for creating LbCas12a Saturation Mutagenesis Library

| Name | Sequence (5'→3') | SEQ ID NO |
|---|---|---|
| LbCas12a_NNK_1138 | TGAGCCTGATGCTGCAGATGNNKAATAGCATTACCGGTCGCAC | 5160 |
| LbCas12a_NNK_1139 | GCCTGATGCTGCAGATGCGTNNKAGCATTACCGGTCGCACCGA | 5161 |
| LbCas12a_NNK_1140 | TGATGCTGCAGATGCGTAATNNKATTACCGGTCGCACCGATGT | 5162 |
| LbCas12a_NNK_1141 | TGCTGCAGATGCGTAATAGCNNKACCGGTCGCACCGATGTGGA | 5163 |
| LbCas12a_NNK_1142 | TGCAGATGCGTAATAGCATTNNKGGTCGCACCGATGTGGATTT | 5164 |
| LbCas12a_NNK_1143 | AGATGCGTAATAGCATTACCNNKCGCACCGATGTGGATTTTCT | 5165 |
| LbCas12a_NNK_1144 | TGCGTAATAGCATTACCGGTNNKACCGATGTGGATTTTCTGAT | 5166 |
| LbCas12a_NNK_1145 | GTAATAGCATTACCGGTCGCNNKGATGTGGATTTTCTGATTAG | 5167 |
| LbCas12a_NNK_1146 | ATAGCATTACCGGTCGCACCNNKGTGGATTTTCTGATTAGTCC | 5168 |
| LbCas12a_NNK_1147 | GCATTACCGGTCGCACCGATNNKGATTTTCTGATTAGTCCGGT | 5169 |
| LbCas12a_NNK_1148 | TTACCGGTCGCACCGATGTGNNKTTTCTGATTAGTCCGGTGAA | 5170 |
| LbCas12a_NNK_1149 | CCGGTCGCACCGATGTGGATNNKCTGATTAGTCCGGTGAAAAA | 5171 |
| LbCas12a_NNK_1150 | GTCGCACCGATGTGGATTTTNNKATTAGTCCGGTGAAAAATTC | 5172 |
| LbCas12a_NNK_1151 | GCACCGATGTGGATTTTCTGNNKAGTCCGGTGAAAAATTCCGA | 5173 |
| LbCas12a_NNK_1152 | CCGATGTGGATTTTCTGATTNNKCCGGTGAAAAATTCCGATGG | 5174 |
| LbCas12a_NNK_1153 | ATGTGGATTTTCTGATTAGTNNKGTGAAAAATTCCGATGGCAT | 5175 |
| LbCas12a_NNK_1154 | TGGATTTTCTGATTAGTCCGNNKAAAAATTCCGATGGCATCTT | 5176 |
| LbCas12a_NNK_1155 | ATTTTCTGATTAGTCCGGTGNNKAATTCCGATGGCATCTTTTA | 5177 |
| LbCas12a_NNK_1156 | TTCTGATTAGTCCGGTGAAANNKTCCGATGGCATCTTTTATGA | 5178 |
| LbCas12a_NNK_1157 | TGATTAGTCCGGTGAAAAATNNKGATGGCATCTTTTATGATAG | 5179 |
| LbCas12a_NNK_1158 | TTAGTCCGGTGAAAAATTCCNNKGGCATCTTTTATGATAGCCG | 5180 |
| LbCas12a_NNK_1159 | GTCCGGTGAAAAATTCCGATNNKATCTTTTATGATAGCCGCAA | 5181 |
| LbCas12a_NNK_1160 | CGGTGAAAAATTCCGATGGCNNKTTTTATGATAGCCGCAATTA | 5182 |
| LbCas12a_NNK_1161 | TGAAAAATTCCGATGGCATCNNKTATGATAGCCGCAATTACGA | 5183 |
| LbCas12a_NNK_1162 | AAAATTCCGATGGCATCTTTNNKGATAGCCGCAATTACGAAGC | 5184 |
| LbCas12a_NNK_1163 | ATTCCGATGGCATCTTTTATNNKAGCCGCAATTACGAAGCACA | 5185 |
| LbCas12a_NNK_1164 | CCGATGGCATCTTTTATGATNNKCGCAATTACGAAGCACAAGA | 5186 |
| LbCas12a_NNK_1165 | ATGGCATCTTTTATGATAGCNNKAATTACGAAGCACAAGAAAA | 5187 |
| LbCas12a_NNK_1166 | GCATCTTTTATGATAGCCGCNNKTACGAAGCACAAGAAAATGC | 5188 |
| LbCas12a_NNK_1167 | TCTTTTATGATAGCCGCAATNNKGAAGCACAAGAAAATGCAAT | 5189 |
| LbCas12a_NNK_1168 | TTTATGATAGCCGCAATTACNNKGCACAAGAAAATGCAATTCT | 5190 |
| LbCas12a_NNK_1169 | ATGATAGCCGCAATTACGAANNKCAAGAAAATGCAATTCTGCC | 5191 |
| LbCas12a_NNK_1170 | ATAGCCGCAATTACGAAGCANNKGAAAATGCAATTCTGCCGAA | 5192 |
| LbCas12a_NNK_1171 | GCCGCAATTACGAAGCACAANNKAATGCAATTCTGCCGAAAAA | 5193 |
| LbCas12a_NNK_1172 | GCAATTACGAAGCACAAGAANNKGCAATTCTGCCGAAAAACGC | 5194 |
| LbCas12a_NNK_1173 | ATTACGAAGCACAAGAAAATNNKATTCTGCCGAAAAACGCAGA | 5195 |
| LbCas12a_NNK_1174 | ACGAAGCACAAGAAAATGCANNKCTGCCGAAAAACGCAGATGC | 5196 |

TABLE 3-continued

Primers for creating LbCas12a Saturation Mutagenesis Library

| Name | Sequence (5'→3') | SEQ ID NO |
|---|---|---|
| LbCas12a_NNK_1175 | AAGCACAAGAAAATGCAATTNNKCCGAAAAACGCAGATGCAAA | 5197 |
| LbCas12a_NNK_1176 | CACAAGAAAATGCAATTCTGNNKAAAAACGCAGATGCAAATGG | 5198 |
| LbCas12a_NNK_1177 | AAGAAAATGCAATTCTGCCGNNKAACGCAGATGCAAATGGTGC | 5199 |
| LbCas12a_NNK_1178 | AAAATGCAATTCTGCCGAAANNKGCAGATGCAAATGGTGCATA | 5200 |
| LbCas12a_NNK_1179 | ATGCAATTCTGCCGAAAAACNNKGATGCAAATGGTGCATATAA | 5201 |
| LbCas12a_NNK_1180 | CAATTCTGCCGAAAAACGCANNKGCAAATGGTGCATATAACAT | 5202 |
| LbCas12a_NNK_1181 | TTCTGCCGAAAAACGCAGATNNKAATGGTGCATATAACATTGC | 5203 |
| LbCas12a_NNK_1182 | TGCCGAAAAACGCAGATGCANNKGGTGCATATAACATTGCACG | 5204 |
| LbCas12a_NNK_1183 | CGAAAAACGCAGATGCAAATNNKGCATATAACATTGCACGTAA | 5205 |
| LbCas12a_NNK_1184 | AAAACGCAGATGCAAATGGTNNKTATAACATTGCACGTAAAGT | 5206 |
| LbCas12a_NNK_1185 | ACGCAGATGCAAATGGTGCANNKAACATTGCACGTAAAGTTCT | 5207 |
| LbCas12a_NNK_1186 | CAGATGCAAATGGTGCATATNNKATTGCACGTAAAGTTCTGTG | 5208 |
| LbCas12a_NNK_1187 | ATGCAAATGGTGCATATAACNNKGCACGTAAAGTTCTGTGGGC | 5209 |
| LbCas12a_NNK_1188 | CAAATGGTGCATATAACATTNNKCGTAAAGTTCTGTGGGCAAT | 5210 |
| LbCas12a_NNK_1189 | ATGGTGCATATAACATTGCANNKAAAGTTCTGTGGGCAATTGG | 5211 |
| LbCas12a_NNK_1190 | GTGCATATAACATTGCACGTNNKGTTCTGTGGGCAATTGGCCA | 5212 |
| LbCas12a_NNK_1191 | CATATAACATTGCACGTAAANNKCTGTGGGCAATTGGCCAGTT | 5213 |
| LbCas12a_NNK_1192 | ATAACATTGCACGTAAAGTTNNKTGGGCAATTGGCCAGTTTAA | 5214 |
| LbCas12a_NNK_1193 | ACATTGCACGTAAAGTTCTGNNKGCAATTGGCCAGTTTAAGAA | 5215 |
| LbCas12a_NNK_1194 | TTGCACGTAAAGTTCTGTGGNNKATTGGCCAGTTTAAGAAAGC | 5216 |
| LbCas12a_NNK_1195 | CACGTAAAGTTCTGTGGGCANNKGGCCAGTTTAAGAAAGCAGA | 5217 |
| LbCas12a_NNK_1196 | GTAAAGTTCTGTGGGCAATTNNKCAGTTTAAGAAAGCAGAAGA | 5218 |
| LbCas12a_NNK_1197 | AAGTTCTGTGGGCAATTGGCNNKTTTAAGAAAGCAGAAGATGA | 5219 |
| LbCas12a_NNK_1198 | TTCTGTGGGCAATTGGCCAGNNKAAGAAAGCAGAAGATGAGAA | 5220 |
| LbCas12a_NNK_1199 | TGTGGGCAATTGGCCAGTTTNNKAAAGCAGAAGATGAGAAGCT | 5221 |
| LbCas12a_NNK_1200 | GGGCAATTGGCCAGTTTAAGNNKGCAGAAGATGAGAAGCTGGA | 5222 |
| LbCas12a_NNK_1201 | CAATTGGCCAGTTTAAGAAANNKGAAGATGAGAAGCTGGACAA | 5223 |
| LbCas12a_NNK_1202 | TTGGCCAGTTTAAGAAAGCANNKGATGAGAAGCTGGACAAAGT | 5224 |
| LbCas12a_NNK_1203 | GCCAGTTTAAGAAAGCAGAANNKGAGAAGCTGGACAAAGTGAA | 5225 |
| LbCas12a_NNK_1204 | AGTTTAAGAAAGCAGAAGATNNKAAGCTGGACAAAGTGAAAAT | 5226 |
| LbCas12a_NNK_1205 | TTAAGAAAGCAGAAGATGAGNNKCTGGACAAAGTGAAAATTGC | 5227 |
| LbCas12a_NNK_1206 | AGAAAGCAGAAGATGAGAAGNNKGACAAAGTGAAAATTGCGAT | 5228 |
| LbCas12a_NNK_1207 | AAGCAGAAGATGAGAAGCTGNNKAAAGTGAAAATTGCGATCAG | 5229 |
| LbCas12a_NNK_1208 | CAGAAGATGAGAAGCTGGACNNKGTGAAAATTGCGATCAGCAA | 5230 |
| LbCas12a_NNK_1209 | AAGATGAGAAGCTGGACAAANNKAAAATTGCGATCAGCAATAA | 5231 |
| LbCas12a_NNK_1210 | ATGAGAAGCTGGACAAAGTGNNKATTGCGATCAGCAATAAAGA | 5232 |
| LbCas12a_NNK_1211 | AGAAGCTGGACAAAGTGAAANNKGCGATCAGCAATAAAGAGTG | 5233 |
| LbCas12a_NNK_1212 | AGCTGGACAAAGTGAAAATTNNKATCAGCAATAAAGAGTGGCT | 5234 |

TABLE 3-continued

Primers for creating LbCas12a Saturation Mutagenesis Library

| Name | Sequence (5'→3') | SEQ ID NO |
|---|---|---|
| LbCas12a_NNK_1213 | TGGACAAAGTGAAAATTGCGNNKAGCAATAAAGAGTGGCTGGA | 5235 |
| LbCas12a_NNK_1214 | ACAAAGTGAAAATTGCGATCNNKAATAAAGAGTGGCTGGAATA | 5236 |
| LbCas12a_NNK_1215 | AAGTGAAAATTGCGATCAGCNNKAAAGAGTGGCTGGAATACGC | 5237 |
| LbCas12a_NNK_1216 | TGAAAATTGCGATCAGCAATNNKGAGTGGCTGGAATACGCACA | 5238 |
| LbCas12a_NNK_1217 | AAATTGCGATCAGCAATAAANNKTGGCTGGAATACGCACAGAC | 5239 |
| LbCas12a_NNK_1218 | TTGCGATCAGCAATAAAGAGNNKCTGGAATACGCACAGACCAG | 5240 |
| LbCas12a_NNK_1219 | CGATCAGCAATAAAGAGTGGNNKGAATACGCACAGACCAGCGT | 5241 |
| LbCas12a_NNK_1220 | TCAGCAATAAAGAGTGGCTGNNKTACGCACAGACCAGCGTTAA | 5242 |
| LbCas12a_NNK_1221 | GCAATAAAGAGTGGCTGGAANNKGCACAGACCAGCGTTAAACA | 5243 |
| LbCas12a_NNK_1222 | ATAAAGAGTGGCTGGAATACNNKCAGACCAGCGTTAAACATGG | 5244 |
| LbCas12a_NNK_1223 | AAGAGTGGCTGGAATACGCANNKACCAGCGTTAAACATGGTCG | 5245 |
| LbCas12a_NNK_1224 | AGTGGCTGGAATACGCACAGNNKAGCGTTAAACATGGTCGTAG | 5246 |
| LbCas12a_NNK_1225 | GGCTGGAATACGCACAGACCNNKGTTAAACATGGTCGTAGCAG | 5247 |
| LbCas12a_NNK_1226 | TGGAATACGCACAGACCAGCNNKAAACATGGTCGTAGCAGTGA | 5248 |
| LbCas12a_NNK_1227 | AATACGCACAGACCAGCGTTNNKCATGGTCGTAGCAGTGATGA | 5249 |
| LbCas12a_NNK_1228 | ACGCACAGACCAGCGTTAAANNKGGTCGTAGCAGTGATGATGA | 5250 |

N is randomly A, C, G, or T in nucleotides 21 and 22 in the sequences.

To demonstrate the utility of the results, the phenotype of LbCas12a mutations at those positions with known outcome were evaluated first, including N527, E795, D156, G532, and K538, that correspond to the M537, F870, E174, S542, or K548 mutations in AsCas12a.

In previous studies, M537R and F870L were selected to create AsCas12a-Ultra to enhance cleavage activity. See U.S. Patent App. Publication No. US 2020/0109382 A1, which is incorporated by reference herein. As the secondary choice at each position, M537K and F870I were beneficial but to a lower degree (Table 4). However, only E795L was successfully transferred to LbCas12a, where N527R negatively affected the enzymatic activity. This discrepancy between AsCas12a and LbCas12a was accurately reflected throughout the screen.

TABLE 4

Mutations in *Acidaminococcus* sp. Cas12a (AsCas12a-Ultra)

| AsCas12a-Ultra | Position 1 | Position 2 |
|---|---|---|
| Optimal | M537R | F870L |
| Secondary | M537K | F870L |

Figure 3A:
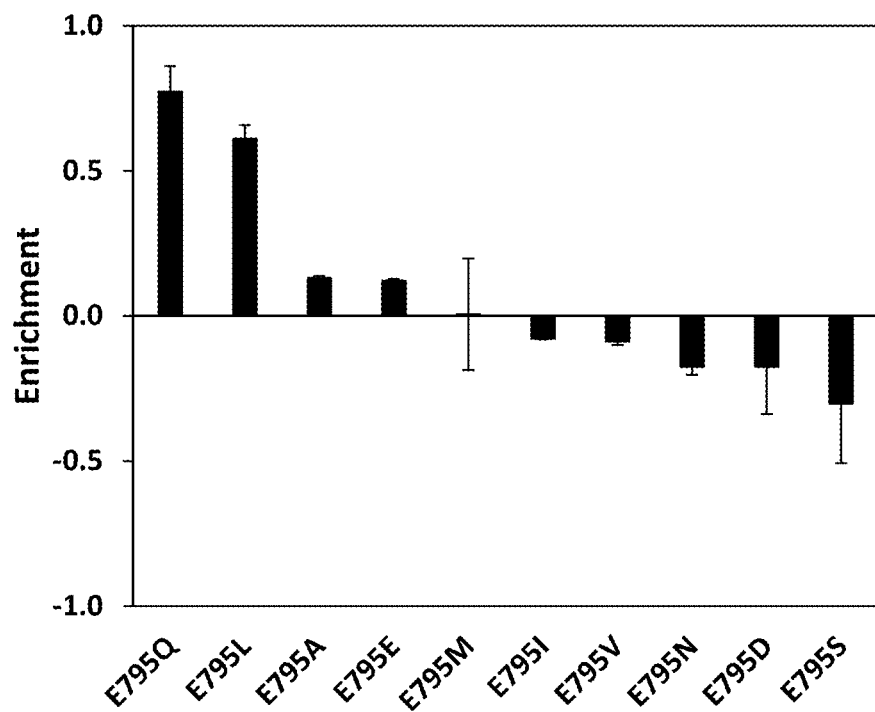
Figure 3B:
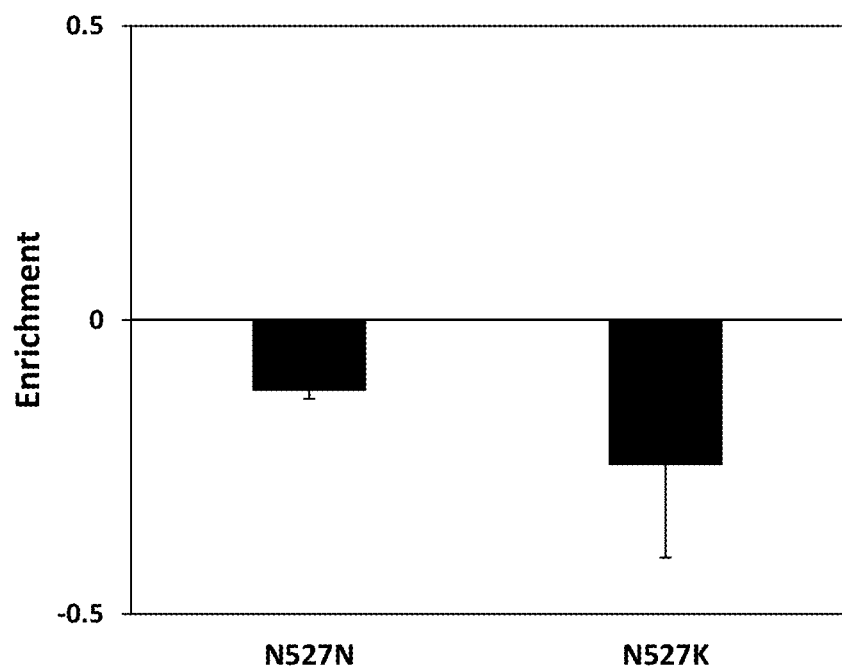
FIG. 3B shows exemplary phenotype scores of N527N and N527K. The other point mutations at this position dropped out of the screen, indicating any change at this position is detrimental.

Examination of the phenotype scores of mutations at E795 revealed a beneficial phenotype of E795L, but not E795I. Moreover, the E795Q outperformed others as the optimal choice of this position (FIG. 3A). In contrast, other than N527N and N527K, most mutations at position N527 dropped out of the screen. Further, compared to the synonymous change (N527N), N527K displayed strong negative phenotype (FIG. 3B). These data indicate mutations at position N527 of LbCas12a is generally detrimental, which is consonant with previous finding on the loss-of-activity of N527R mutant.

Figure 4A:
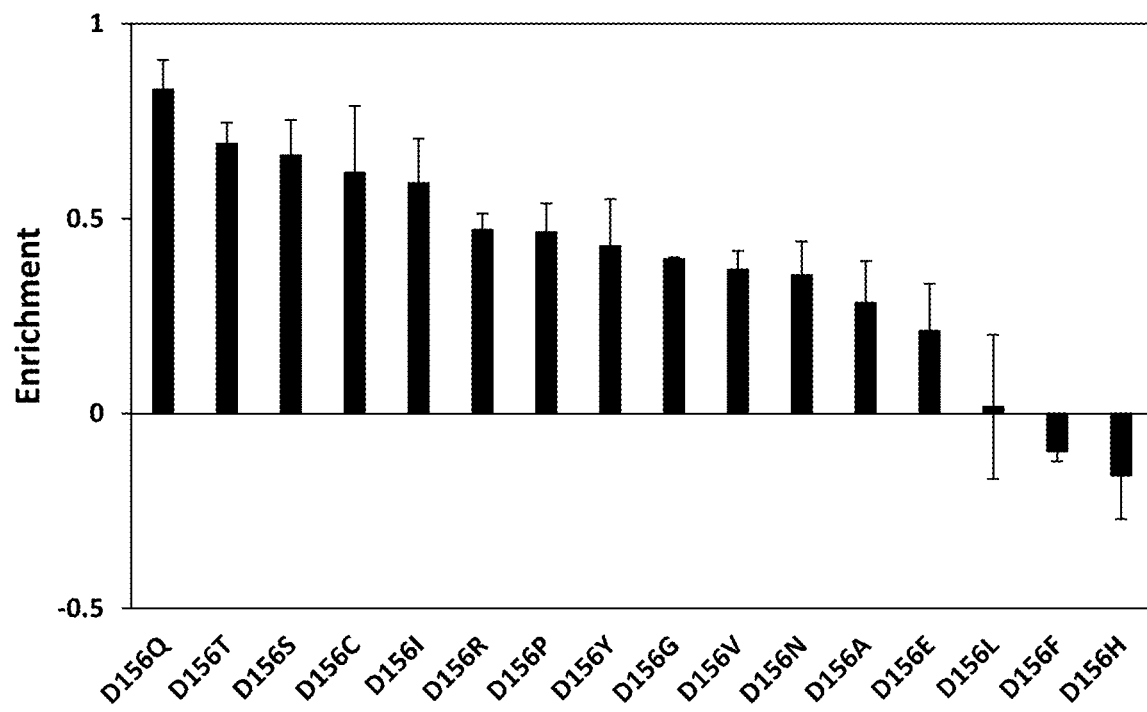
FIG. 4A shows exemplary phenotype scores of point mutations at position D156. A majority of the mutations are tolerated well at this position; leucine appears neutral; and phenylalanine or histidine are detrimental at this position.
Figure 4B:
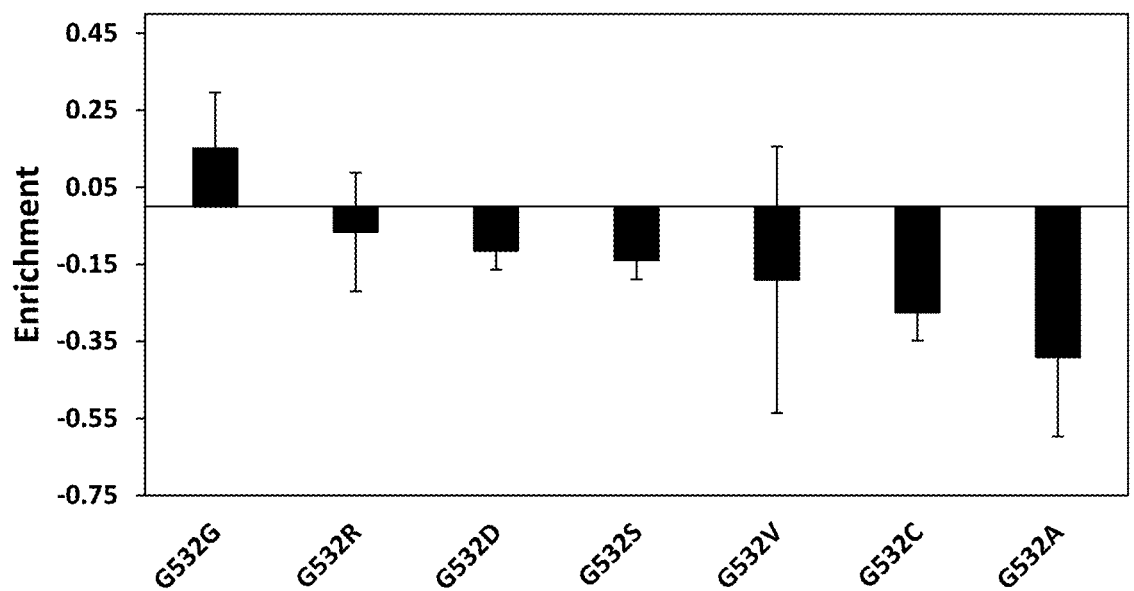
FIG. 4B shows exemplary phenotype scores of point mutations at position G532. Most of the mutations are detrimental at this position.
Figure 5A:
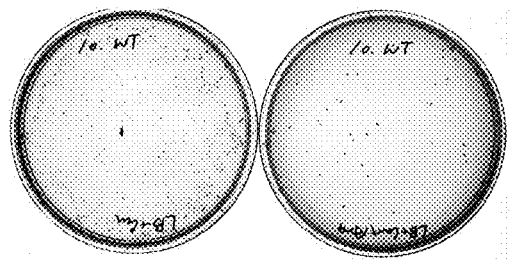
FIG. 5A-J show wild-type LbCas12a (FIG. 5A) and exemplary point mutations (FIG. 5B-J) of with enhanced DNA cleavage activity at TTTT PAM versus a negative control (no HPRT38346 gRNA.
Figure 5B:
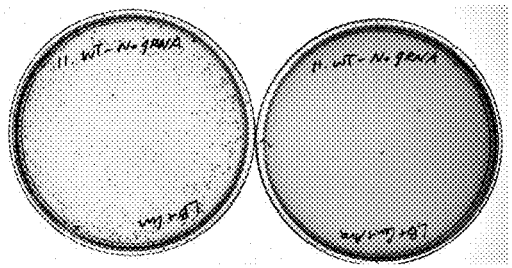
Figure 5C:
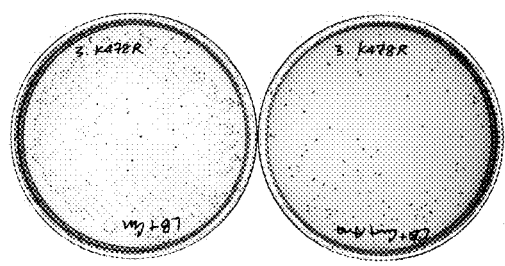
Figure 5D:
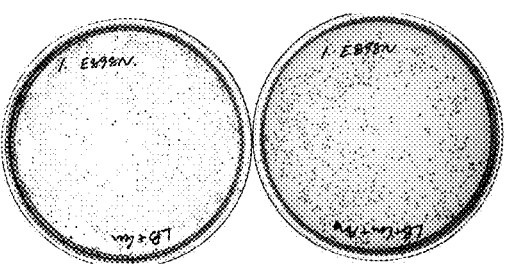
Figure 5E:
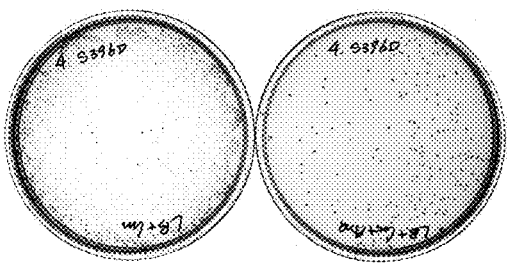
Figure 5F:
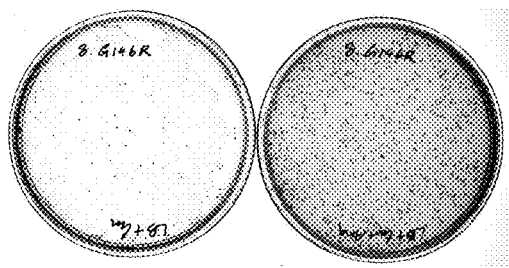
Figure 5G:
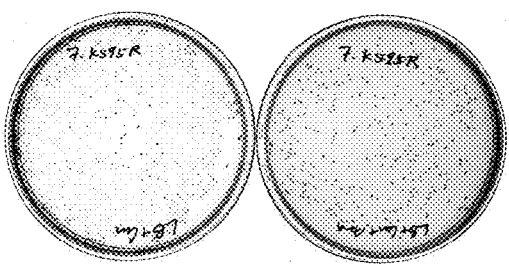
Figure 5H:
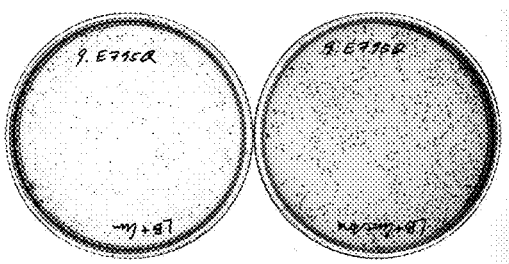
Figure 5I:
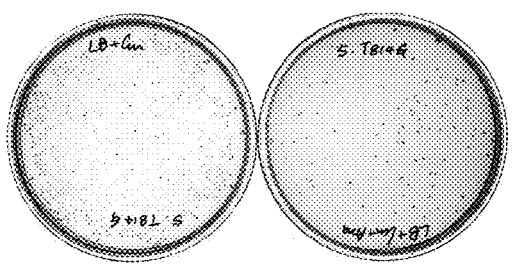
Figure 5J:
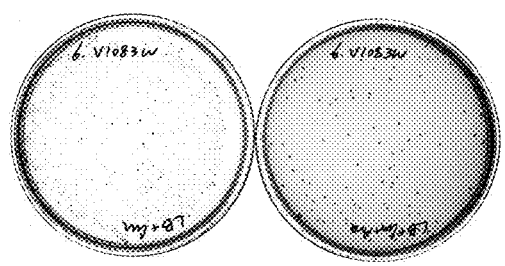

The effect of mutations at D156, G532, and K538 in LbCas12a (Table 5) were evaluated further, since the corresponding mutant (E174R/S542R/K548R) in AsCas12a has previously been shown to improve the activity. First, most mutations at D156, including the D156R, had phenotype scores greater than WT, indicating the analogous mutant discovered in AsCas12a (E174R) can be transferred to LbCas12a with similar outcome (FIG. 4A). The current screen further revealed the D156Q as an optimal mutant. Mutations at G532, including G532R, reduced the activity (FIG. 4B). Nearly all mutants at K538 dropped out of the screen, suggesting mutations at this position are not generally tolerated (data not shown).

TABLE 5

Mutations at D156, G532, and K538 in LbCas12a

| | Mutant 1 | Mutant 2 | Mutant 3 |
|---|---|---|---|
| EnAsCas12a | E184R | S542R | K548R |
| EnLbCas12a | D156R | G523R | K538R |

These results were consistent with previous studies showing D156R is a beneficial mutation for LbCas12a (FIG. 4A). See Schindele and Puchta, *Plant Biotechnol J.* 18(5): 1118-1120 (2010), which is incorporated by reference herein. Taken together, the high-throughput data accurately reproduced and identified mutations with known outcome. In addition, these experiments suggest that point mutations discovered in one Cas12a family member cannot be reliably transferred to others, as most of the activity-enhancing mutants identified in AsCas12a were detrimental in LbCas12a.

Guided by the high-throughput results, a set of LbCas12a variants with novel point mutations (G146R, S396D, K478R, K595R, E795Q, T814G, E898N and V1083W) were cloned and tested for their activity in the context of bacteria selection assay. As shown in FIG. 5C-J, these mutants improved the survival rate of bacteria over WT-LbCas12a upon selection, suggesting they can be added to the WT-LbCas12a, to enhance its intrinsic cleavage activity at TTTT-PAM.

TABLE 6

LbCas12a Single Mutants with Greatest Activity (top-10) and Single Mutants Selected for Further Evaluation

| Mutation | Average Score | Std. Dev. | SEQ ID NO: |
|---|---|---|---|
| K278D | 3.8 | 0.32 | 4 |
| E433P | 3.37 | 2.93 | 6 |
| V1209R | 3.05 | 2.28 | 8 |
| K878A | 3.02 | 2.73 | 10 |
| A920P | 2.92 | 0.37 | 12 |
| G715R | 2.92 | 3.25 | 14 |
| N732L | 2.75 | 2.81 | 16 |
| I922R | 2.75 | 0.12 | 18 |
| S431T | 2.69 | 2.93 | 20 |
| F745T | 2.46 | 3.01 | 22 |
| E898N | 2.03 | 0.02 | 48 |
| H909K | 1.86 | 0.18 | 70 |
| R182V | 1.7 | 0.11 | 98 |
| S396D | 1.67 | 0.19 | 108 |
| E858V | 1.65 | 0 | 114 |
| K478R | 1.57 | 0.05 | 134 |
| V1083W | 1.57 | 0.18 | 132 |
| G146R | 1.49 | 0.02 | 156 |
| T814G | 1.48 | 0.05 | 162 |
| K595R | 1.4 | 0.08 | 184 |
| I860R | 1.29 | 0.28 | 250 |
| E125K | 1.06 | 0.04 | 428 |
| S1020E | 0.98 | 0.12 | 532 |
| K1121D | 0.94 | 0.1 | 598 |
| Y606F | 0.92 | 0.07 | 642 |
| T152K | 0.9 | 0.03 | 694 |
| P799V | 0.89 | 0.02 | 706 |
| Y646H | 0.87 | 0.01 | 720 |
| F81E | 0.82 | 0.08 | 802 |

TABLE 6-continued

LbCas12a Single Mutants with Greatest Activity (top-10) and Single Mutants Selected for Further Evaluation

| Mutation | Average Score | Std. Dev. | SEQ ID NO: |
|---|---|---|---|
| L839F | 0.8 | 0.18 | 834 |
| E981V | 0.79 | 0.03 | 880 |
| E795Q | 0.77 | 0.09 | 930 |
| V491D | 0.77 | 0.1 | 954 |
| I841A | 0.76 | 0.03 | 988 |
| D665N | 0.74 | 0.09 | 1014 |
| N582R | 0.55 | 0.06 | 1730 |
| E913R | 0.49 | 0.03 | 1960 |
| N145R | 0.35 | 0.01 | 2902 |
| W890A | — | — | 3958 |

The ten mutants with top activity in Table 6 are not necessarily the best mutants for enhanced editing at TTTT-PAMs. This is because the phenotype is measured in E. coli cells. Other than enhancing DNA cleavage, some mutants were enriched because they reduced toxicity to the host cells or improved solubility or expression level of LbCas12a in E. coli. These variants are useful for genome editing of E. coli or other bacteria where the toxicity of CRISPR enzymes (Cas12a or Cas9) is a known issue. The WT enzymes are thought to be toxic which cause poor transformation efficiency and editing efficiency. Reducing the toxicity, activity, or expression level of CRISPR enzymes has been shown in the literature to improve editing efficiency. However, this type of toxicity is typically not an issue in mammalian cells. Therefore, to obtain mutants that work better in human cells, further validation of a selected set of mutants was tested in HEK293 cells.

Example 2

LbCas12a Mutants with Enhanced Activity

LbCas12a variants evaluated in this study are listed in Table 7. Site directed mutagenesis was performed to introduce specific point mutations on the expression vector using primers listed in Table 8. The phenotypes of specific single, double, triple, quadruple, quintuple, and sextuple mutations were evaluated in E. coli as the colony formation unit (CFU) of each mutant. Those mutants with enhanced CFU upon selection indicated an improved editing efficiency in E. coli, regardless of the underlying mechanism.

TABLE 7

LbCas12a variants. Variants with enhanced activity over WT-LbCas12a are indicated with "*".

| No. | Mutation | Nucleotide SEQ ID NO: | Polypeptide SEQ ID NO: |
|---|---|---|---|
| — | Wild-type LbCas12a | 1 | 2 |
| 1 | F81E* | 801 | 802 |
| 2 | E125K* | 427 | 428 |
| 3 | N145R* | 2901 | 2902 |
| 4 | G146R* | 155 | 156 |
| 5 | T152K* | 693 | 694 |
| 6 | R182V* | 97 | 98 |
| 7 | V491D* | 953 | 954 |
| 8 | K478R* | 133 | 134 |
| 9 | N582R* | 1729 | 1730 |
| 10 | Y606F | 641 | 642 |
| 11 | Y646H | 719 | 720 |
| 12 | D665N* | 1013 | 1014 |
| 13 | E795Q* | 929 | 930 |
| 14 | P799V* | 705 | 706 |
| 15 | L839F | 833 | 834 |
| 16 | I841A | 987 | 988 |
| 17 | E858V* | 113 | 114 |

TABLE 7-continued

LbCas12a variants. Variants with enhanced activity over WT-LbCas12a are indicated with "*".

| No. | Mutation | Nucleotide SEQ ID NO: | Polypeptide SEQ ID NO: |
|---|---|---|---|
| 18 | I860R* | 249 | 250 |
| 19 | W890A | 3957 | 3958 |
| 20 | E898N | 47 | 48 |
| 21 | H909K | 69 | 70 |
| 22 | E913R* | 1959 | 1960 |
| 23 | E981V* | 879 | 880 |
| 24 | S1020E | 531 | 532 |
| 25 | K1121D | 597 | 598 |
| 26 | E88A/E795Q* | 3959 | 3960 |
| 27 | E125K/E795Q* | 3961 | 3962 |
| 28 | G146R/E795Q* | 3963 | 3964 |
| 29 | R182V/E795Q* | 3965 | 3966 |
| 30 | V491D/E795Q* | 3967 | 3968 |
| 31 | Q529I/E795Q* | 3969 | 3970 |
| 32 | Y646H/E795Q* | 3971 | 3972 |
| 33 | D665N/E795Q* | 3973 | 3974 |
| 34 | T814K/E795Q* | 3975 | 3976 |
| 35 | L839F/E795Q* | 3977 | 3978 |
| 36 | Q906F/E795Q* | 3979 | 3980 |
| 37 | E795Q/Q1170D* | 3981 | 3982 |
| 38 | G146R/R182V/E795Q* | 3983 | 3984 |
| 39 | G146R/E795Q/D665N* | 3985 | 3986 |
| 40 | G146R/E795Q/E981V* | 3987 | 3988 |
| 41 | G146R/E795Q/T814K* | 3989 | 3990 |
| 42 | G146R/R182V/D665N* | 3991 | 3992 |
| 43 | E125K/R182V/E981V* | 3993 | 3994 |
| 44 | R182V/P799V/E981V* | 3995 | 3996 |
| 45 | R182V/T814K/E981V* | 3997 | 3998 |
| 46 | G146R/P799V/E981V* | 3999 | 4000 |
| 47 | G146R/R182V/E795Q/F81E* | 4001 | 4002 |
| 48 | G146R/R182V/E795Q/E125K* | 4003 | 4004 |
| 49 | G146R/R182V/E795Q/E125A* | 4005 | 4006 |
| 50 | G146R/R182V/E795Q/P799V* | 4007 | 4008 |
| 51 | G146R/R182V/E795Q/T814K* | 4009 | 4010 |
| 52 | G146R/R182V/E795Q/E981V* | 4011 | 4012 |
| 53 | G146R/R182V/E795Q/D665N* | 4013 | 4014 |
| 54 | G146R/R182V/P799V/E981V* | 4015 | 4016 |
| 55 | E125K/G146R/R182V/E795Q/D665N* | 4017 | 4018 |
| 56 | G146R/R182V/E795Q/P799V/T814K* | 4019 | 4020 |
| 57 | E125K/G146R/R182V/E795Q/D665N/E981V | 4021 | 4022 |

TABLE 8

Primers used for site directed mutagenesis of LbCas12a.

| No | Primer | Sequence (5'→3') | SEQ ID NO |
|---|---|---|---|
| 1 | Lb_F81E_F | CCTGAACAACTATATCAGCCTGGAACGTAAAAAACCCGCACC | 5251 |
| 2 | Lb_F81E_R | GGTGCGGGTTTTTTACGTTCCAGGCTGATATAGTTGTTCAGG | 5252 |
| 3 | Lb_E88A_F | GTAAAAAACCCGCACCGCGAAAGAAAACAAAGAGCTGGAAAA | 5253 |
| 4 | Lb_E88A_R | TTTTCCAGCTCTTTGTTTTCTTTCGCGGTGCGGGTTTTTTAC | 5254 |
| 5 | Lb_E125K_F | CCTGTTCAAGAAAGACATCATCAAAACCATTCTGCCGGAATTTC | 5255 |
| 6 | Lb_E125K_R | GAAATTCCGGCAGAATGGTTTTGATGATGTCTTTCTTGAACAGG | 5256 |
| 7 | Lb_E125A_F | CCTGTTCAAGAAAGACATCATCGCGACCATTCTGCCGGAATTTC | 5257 |
| 8 | Lb_E125A_R | GAAATTCCGGCAGAATGGTCGCGATGATGTCTTTCTTGAACAGG | 5258 |
| 9 | Lb_N145R_F | GCCCTGGTGAATAGCTTTCGTGGCTTTACCACCGCATTTAC | 5259 |
| 10 | Lb_N145R_R | GTAAATGCGGTGGTAAAGCCACGAAAGCTATTCACCAGGGC | 5260 |
| 11 | Lb_G146R_F | CCCTGGTGAATAGCTTTAATCGTTTTACCACCGCATTTACCG | 5261 |
| 12 | Lb_G146R_R | CGGTAAATGCGGTGGTAAAACGATTAAAGCTATTCACCAGGG | 5262 |

TABLE 8-continued

Primers used for site directed mutagenesis of LbCas12a.

| No | Primer | Sequence (5'→3') | SEQ ID NO |
|---|---|---|---|
| 13 | Lb_T152K_F | GGCTTTACCACCGCATTTAAAGGCTTTTTTGATAATCGCGAA | 5263 |
| 14 | Lb_T152K_R | TTCGCGATTATCAAAAAAGCCTTTAAATGCGGTGGTAAAGCC | 5264 |
| 15 | Lb_R182V_F | GCTGCATTAATGAAAATCTGACCGTGTACATTAGCAACATGGATATCTTTGA | 5265 |
| 16 | Lb_R182V_R | TCAAAGATATCCATGTTGCTAATGTACACGGTCAGATTTTCATTAATGCAGC | 5266 |
| 17 | Lb_V491D_F | TGAAAGTTTCTATGGCGATTTTGATCTGGCCTATGATATTCTGCTG | 5267 |
| 18 | Lb_V491D_R | CAGCAGAATATCATAGGCCAGATCAAAATCGCCATAGAAACTTTCA | 5268 |
| 19 | Lb_K478R_F | AAGCCTTTTTTGGTGAGGGCCGTGAAACCAATCGTGATGAAAG | 5269 |
| 20 | Lb_K478R_R | CTTTCATCACGATTGGTTTCACGGCCCTCACCAAAAAAGGCTT | 5270 |
| 21 | Lb_Q529I_F | AACTGTACTTTCAGAACCCGATTTTTATGGGTGGTTGGGATAAAG | 5271 |
| 22 | Lb_Q529I_R | CTTTATCCCAACCACCCATAAAAATCGGGTTCTGAAAGTACAGTT | 5272 |
| 23 | Lb_N582R_F | GTGAATGGCAACTATGAAAAAATCCGTTACAAACTGCTGCCTGGT | 5273 |
| 24 | Lb_N582R_R | ACCAGGCAGCAGTTTGTAACGGATTTTTTCATAGTTGCCATTCAC | 5274 |
| 25 | Lb_Y606F_F | GCAAGAAATGGATGGCCTATTTTAACCCGAGCGAGGATATT | 5275 |
| 26 | Lb_Y606F_R | AATATCCTCGCTCGGGTTAAAATAGGCCATCCATTTCTTGC | 5276 |
| 27 | Lb_Y646H_F | TTCAAAGATTCAATTTCGCGTCATCCGAAATGGTCCAATGC | 5277 |
| 28 | Lb_Y646H_R | GCATTGGACCATTTCGGATGACGCGAAATTGAATCTTTGAA | 5278 |
| 29 | Lb_D665N_F | CTTTAGCGAAACCGAAAAATACAAAAACATTGCCGGTTTTTATCG | 5279 |
| 30 | Lb_D665N_R | CGATAAAAACCGGCAATGTTTTTGTATTTTTCGGTTTCGCTAAAG | 5280 |
| 31 | Lb_E795Q_F | GTTTTAGCGAGGATCAGTATCAGCTGCATATCCCGATTGCCAT | 5281 |
| 32 | Lb_E795Q_R | ATGGCAATCGGGATATGCAGCTGATACTGATCCTCGCTAAAAC | 5282 |
| 33 | Lb_P799V_F | AGGATCAGTATGAACTGCATATCGTGATTGCCATCAATAAATGCCC | 5283 |
| 34 | Lb_P799V_R | GGGCATTTATTGATGGCAATCACGATATGCAGTTCATACTGATCCT | 5284 |
| 35 | Lb_T814K_F | CCCGAAAAACATCTTTAAGATCAACAAAGAAGTTCGCGTGCTGC | 5285 |
| 36 | Lb_T814K_R | GCAGCACGCGAACTTCTTTGTTGATCTTAAAGATGTTTTTCGGG | 5286 |
| 37 | Lb_L839F_F | CGTGGTGAACGTAACCTGTTTTATATTGTTGTTGATGGTAAAGG | 5287 |
| 38 | Lb_L839F_R | CCTTTACCATCAACAACAATATAAAACAGGTTACGTTCACCACG | 5288 |
| 39 | Lb_I841A_F | GTGAACGTAACCTGCTGTATGCGGTTGTTGATGGTAAAGGC | 5289 |
| 40 | Lb_I841A_R | GCCTTTACCATCAACAACAACCGCATACAGCAGGTTACGTTCAC | 5290 |
| 41 | Lb_E858V_F | GTGGAACAGTATAGTCTGAACGTGATTATCAACAACTTTAACGGCAT | 5291 |
| 42 | Lb_E858V_R | ATGCCGTTAAAGTTGTTGATAATCACGTTCAGACTATACTGTTCCAC | 5292 |
| 43 | Lb_I860R_F | AGTATAGTCTGAACGAAATTCGTAACAACTTTAACGGCATCCG | 5293 |
| 44 | Lb_I860R_R | CGGATGCCGTTAAAGTTGTTACGAATTTCGTTCAGACTATACT | 5294 |
| 45 | Lb_W890A_F | GTTTTGAAGCACGTCAGAACGCGACCAGTATTGAAAACATCAAAGAAC | 5295 |
| 46 | Lb_W890A_R | GTTCTTTGATGTTTTCAATACTGGTCGCGTTCTGACGTGCTTCAAAAC | 5296 |
| 47 | Lb_E898N_F | CCAGTATTGAAAACATCAAAAACCTGAAAGCCGGTTATATTAG | 5297 |
| 48 | Lb_E898N_R | CTAATATAACCGGCTTTCAGGTTTTTGATGTTTTCAATACTGG | 5298 |

TABLE 8-continued

Primers used for site directed mutagenesis of LbCas12a.

| No | Primer | Sequence (5'→3') | SEQ ID NO |
|---|---|---|---|
| 49 | Lb_Q906F_F | CTGAAAGCCGGTTATATTAGCTTTGTGGTTCATAAAATCTGTGAGCT | 5299 |
| 50 | Lb_Q906F_R | AGCTCACAGATTTTATGAACCACAAAGCTAATATAACCGGCTTTCAG | 5300 |
| 51 | Lb_H909K_F | GTTATATTAGCCAGGTGGTTAAAAAAATCTGTGAGCTGGTAGA | 5301 |
| 52 | Lb_H909K_R | TCTACCAGCTCACAGATTTTTTTAACCACCTGGCTAATATAAC | 5302 |
| 53 | Lb_E913R_F | CCAGGTGGTTCATAAAATCTGTCGTCTGGTAGAAAAATACGATGCAGT | 5303 |
| 54 | Lb_E913R_R | ACTGCATCGTATTTTTCTACCAGACGACAGATTTTATGAACCACCTGG | 5304 |
| 55 | Lb_E981V_F | AAAGGTTATCAGATTACCAACAAATTTGTGAGCTTTAAAAGCATGAGCAC | 5305 |
| 56 | Lb_E981V_R | GTGCTCATGCTTTTAAAGCTCACAAATTTGTTGGTAATCTGATAACCTTT | 5306 |
| 57 | Lb_S1020E_F | AACCTGCTGAAAACAAAATATACCGAAATTGCCGACAGCAAGAAG | 5307 |
| 58 | Lb_S1020E_R | CTTCTTGCTGTCGGCAATTTCGGTATATTTTGTTTTCAGCAGGTT | 5308 |
| 59 | Lb_K1121D_F | CTGTGTGAACAGAGCGATGATGCGTTTTATAGCAGTTTTATGGC | 5309 |
| 60 | Lb_K1121D_R | GCCATAAAACTGCTATAAAACGCATCATCGCTCTGTTCACACAG | 5310 |
| 61 | Lb_Q1170D_F | AGCCGCAATTACGAAGCAGATGAAAATGCAATTCTGCCGAAA | 5311 |
| 62 | Lb_Q1170D_R | TTTCGGCAGAATTGCATTTTCATCTGCTTCGTAATTGCGGCT | 5312 |
| 63 | Lb_E795Q/ P799V_F | CGTTTTAGCGAGGATCAGTATCAGCTGCATATCGTGATTGCCATCAATAAATGCCCG | 5313 |
| 64 | Lb_E795Q/ P799V_R | CGGGCATTTATTGATGGCAATCACGATATGCAGCTGATACTGATCCTCGCTAAAACG | 5314 |

The LbCas12a mutants were transformed into *E. coli* BL21(DE3) cells, a colony with the appropriate strain was used to inoculate TB media with kanamycin (0.05 mg/mL) and grown at 37° C. until an OD of approximately 0.9 was reached, then the flask was cooled to 18° C. for 30 minutes. The addition of 500 μL of 1 M IPTG was used to induce protein expression, followed by growth at 18° C. for 19 hours. Cells were harvested and the cell pellet was re-suspended and lysed on an Avestin Emulsiflex C3 pre-chilled to 4° C. at 15-20 kpsi with three passes. The lysate was centrifuged at 16,000×g for 20 minutes at 4° C. to remove cell debris.

The cleared lysate was put over a HisTrap™ HP column (Cytiva). The procedure consisted of equilibrating the resin with His. Bind® buffer (20 mM NaPO₄ pH 6.8, 0.5 M NaCl, 10 mM imidazole, 5% glycerol), followed by sample loading. The sample was washed with His-Bind buffer, followed by an additional standard wash and a 10% "B" wash consisting of 10% His-Elution buffer (10 mM NaPO₄ pH 6.8, 250 mM NaCl, 150 mM imidazole, 5% glycerol). Finally, the sample was eluted using His-Elution buffer.

The partially purified Cas13a variants were then put over a HiTrap® Heparin HP column. The procedure consisted of equilibrating the resin with the Heparin-Bind buffer (20 mM NaPO4 pH 6.8, 250 mM NaCl, 10% glycerol), followed by sample loading. The sample was then washed with Heparin-Bind buffer, followed by a 5% "B" wash consisting of 5% Heparin Elution buffer (10 mM NaPO₄ pH 6.8, 1 M NaCl, 10% glycerol). Finally, the purified protein was eluted using Heparin Elution buffer (10 mM NaPO₄, pH 6.8, 1 M NaCl, 10% glycerol). Finally, the purified protein was eluted using Heparin.

The purified LbCas12a mutants were concentrated to approximately 10 mg/mL and stored at −20° C. in storage buffer containing 25 mM Tris-HCl pH 7.4, 0.3 M NaCl, 1 mM EDTA, 1 mM DTT, and 50% glycerol.

Example 3

Editing Efficiency of LbCas12a Variants in Human Cells

To evaluate the genome editing efficiency of each variant, LbCas12a-RNPs (1 μM) were assembled using 4 crRNAs targeting human HPRT gene (Table 9). The assembled RNPs (50 nM) were delivered into HEK293 cells by Lonza nucleofection (SF buffer, CM-130), and the editing efficiency was measured by T7 endonuclease I assay 48-hours post-delivery (Table 10; FIG. 6A).

TABLE 9 crRNAs and primer sequences used in the T7EI assay.

| Name | Sequence (5'→3') | Purpose | SEQ ID NO |
|---|---|---|---|
| crRNA-1* | UAAUUUCUACUAAGUGUAGAUAACACACCCAAGGAAAGACUAUG | HPRT 38116-AS-23 crRNA | 5315 |
| crRNA-2* | UAAUUUCUACUAAGUGUAGAUAUAGUCUUUCCUUGGGUGUGUUA | HPRT 38094-S-23 crRNA | 5316 |
| crRNA-3* | UAAUUUCUACUAAGUGUAGAUAUCCGUGCUGAGUGUACCAUGCA | HPRT 38146-AS-23 crRNA | 5317 |
| crRNA-4* | UAAUUUCUACUAAGUGUAGAUUUGUAGGAUAUGCCCUUGACUAU | HPRT 38486-S-23 crRNA | 5318 |
| HPRT7 FWD | AAGAATGTTGTGATAAAAGGTGATGCT | Primer for T7EI | 5319 |
| HPRT7 RWD | ACACATCCATGGGACTTCTGCCTC | Primer for T7EI | 5320 |

*Ribonucleotides

Figure 6B:
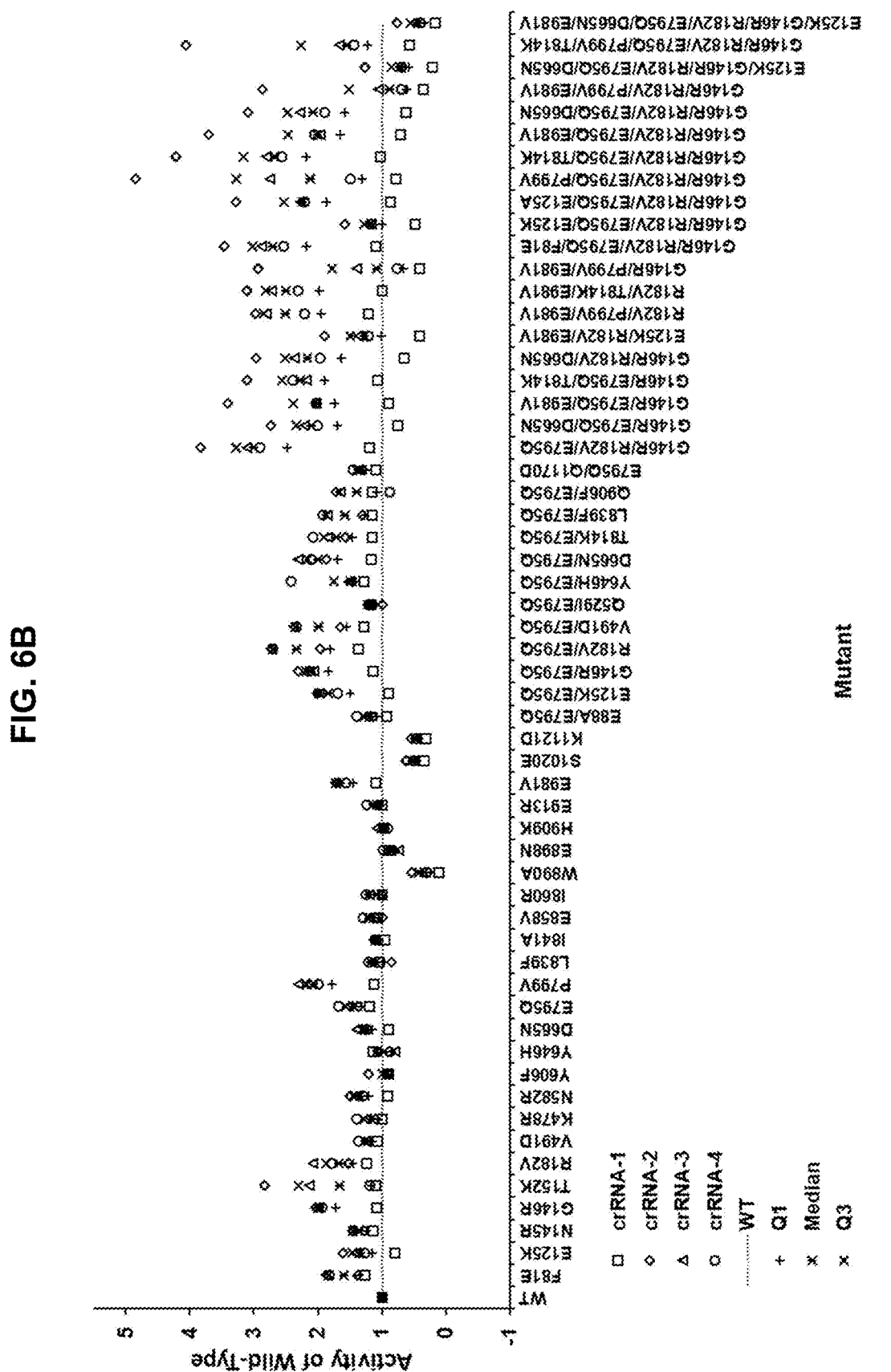

To facilitate comparison, the efficiency of variant at each target was normalized to WT LbCas12a and presented as fold-improvement over WT in Table 11 and FIG. 6B. Overall, 49 of the 57 purified variants containing single or multiple point mutations improved activity over WT at one or multiple sites (Tables 10-11). Triple mutant number 38 (SEQ ID NO: 3984), G146R/R182V/E795Q ("RVQ") had the best performance, with ~3-fold improvement over WT in this assay. Stacking other beneficial mutations on RVQ gradually reduced the activity (see mutants Nos. 47-57, Tables 10-11; FIG. 6A-B). Accordingly, the triple mutant RVQ (No. 38, SEQ ID NO: 3984) appears to be an optimal LbCas12a variant for genome editing.

TABLE 10

LbCas12a Mutant Activity in T7 Endonuclease I Assay with Four crRNAs

| No | Mutant | crRNA-1* | Std Dev | crRNA-2* | Std Dev | crRNA-3* | Std Dev | crRNA-4* | Std Dev |
|---|---|---|---|---|---|---|---|---|---|
| 0 | Wild-Type (WT) | 54.13 | 9.04 | 7.70 | 0.46 | 12.40 | 1.08 | 15.77 | 0.46 |
| 1 | F81E | 60.27 | 0.23 | 9.97 | 0.40 | 22.07 | 1.01 | 26.90 | 1.18 |
| 2 | E125K | 41.03 | 1.26 | 12.47 | 0.70 | 17.60 | 0.70 | 20.23 | 0.61 |
| 3 | N145R | 54.63 | 1.69 | 9.60 | 0.99 | 17.77 | 0.40 | 23.97 | 1.34 |
| 4 | G146R | 56.13 | 0.97 | 16.23 | 1.17 | 25.53 | 0.87 | 32.20 | 0.30 |
| 5 | T152K | 52.77 | 1.63 | 20.93 | 1.01 | 25.33 | 1.50 | 18.60 | 1.06 |
| 6 | R182V | 59.20 | 1.91 | 10.37 | 0.49 | 24.10 | 0.82 | 29.13 | 1.24 |
| 7 | V491D | 52.17 | 1.65 | 8.67 | 1.00 | 17.17 | 0.55 | 21.67 | 0.93 |
| 8 | K478R | 48.50 | 1.83 | 8.83 | 0.75 | 13.67 | 1.36 | 18.55 | 0.49 |
| 9 | N582R | 46.73 | 3.06 | 11.27 | 0.59 | 17.47 | 0.55 | 20.97 | 1.45 |
| 10 | Y606F | 45.43 | 2.04 | 9.33 | 0.95 | 12.97 | 1.36 | 14.87 | 1.86 |
| 11 | Y646H | 55.50 | 2.45 | 7.30 | 0.40 | 9.13 | 0.81 | 13.00 | 1.28 |
| 12 | D665N | 44.37 | 1.33 | 9.17 | 0.38 | 17.10 | 0.66 | 17.93 | 1.80 |
| 13 | E795Q | 59.03 | 1.77 | 9.77 | 1.25 | 18.00 | 0.61 | 26.80 | 1.06 |
| 14 | P799V | 55.27 | 1.07 | 16.70 | 1.25 | 28.47 | 0.45 | 30.70 | 1.57 |
| 15 | L839F | 49.63 | 1.39 | 6.57 | 1.02 | 13.77 | 0.96 | 19.20 | 0.62 |
| 16 | I841A | 46.10 | 1.01 | 8.03 | 1.10 | 12.43 | 1.15 | 16.73 | 0.21 |
| 17 | E858V | 52.13 | 1.31 | 7.30 | 0.82 | 13.63 | 1.04 | 19.63 | 1.16 |
| 18 | I860R | 48.67 | 2.43 | 7.27 | 1.23 | 13.20 | 1.11 | 18.90 | 0.75 |
| 19 | W890A | 4.63 | 2.64 | 3.80 | 0.00 | 4.03 | 0.42 | 4.27 | 0.64 |
| 20 | E898N | 43.27 | 0.45 | 6.00 | 1.31 | 8.33 | 0.40 | 15.10 | 1.11 |
| 21 | H909K | 47.77 | 1.17 | 7.47 | 0.67 | 13.37 | 0.51 | 15.40 | 0.26 |
| 22 | E913R | 52.50 | 1.14 | 8.80 | 0.26 | 14.67 | 0.61 | 20.90 | 0.87 |
| 23 | E981V | 58.03 | 0.71 | 13.80 | 0.10 | 21.77 | 0.55 | 26.37 | 0.99 |
| 24 | S1020E | 17.37 | 0.78 | 4.27 | 0.12 | 5.23 | 0.51 | 7.60 | 0.35 |
| 25 | K1121D | 15.37 | 0.55 | 3.65 | 0.64 | 5.20 | 0.17 | 6.87 | 1.07 |
| 26 | E88A/E795Q | 50.77 | 0.67 | 8.53 | 0.75 | 16.07 | 0.90 | 24.13 | 0.76 |
| 27 | E125K/E795Q | 50.37 | 0.38 | 16.73 | 1.47 | 24.03 | 0.31 | 30.80 | 1.18 |
| 28 | G146R/E795Q | 59.73 | 1.38 | 19.50 | 0.20 | 27.53 | 0.67 | 37.63 | 1.23 |
| 29 | R182V/E795Q | 66.67 | 0.21 | 15.83 | 1.61 | 34.87 | 0.42 | 42.77 | 0.15 |
| 30 | V491D/E795Q | 63.93 | 0.40 | 12.87 | 0.45 | 30.33 | 0.31 | 37.73 | 0.31 |
| 31 | Q529I/E795Q | 58.40 | 0.26 | 8.03 | 1.44 | 16.43 | 0.40 | 18.70 | 7.88 |
| 32 | Y646H/E795Q | 64.83 | 0.83 | 11.70 | 1.08 | 20.20 | 1.82 | 32.23 | 0.58 |
| 33 | D665N/E795Q | 62.70 | 3.29 | 15.17 | 0.98 | 32.10 | 4.81 | 37.67 | 1.55 |
| 34 | T814K/E795Q | 59.07 | 0.67 | 13.40 | 0.26 | 25.17 | 2.86 | 36.97 | 0.61 |
| 35 | L839F/E795Q | 61.00 | 0.28 | 10.93 | 0.15 | 24.63 | 1.42 | 33.93 | 0.65 |
| 36 | Q906F/E795Q | 60.97 | 0.60 | 14.27 | 0.49 | 23.07 | 1.27 | 16.00 | 1.87 |
| 37 | E795Q/Q1170D | 56.33 | 0.85 | 10.20 | 1.65 | 17.80 | 1.22 | 22.77 | 6.77 |
| 38 | G146R/R182V/E795Q | 63.10 | 1.10 | 32.80 | 0.95 | 42.03 | 1.81 | 51.53 | 0.21 |

TABLE 10-continued

LbCas12a Mutant Activity in T7 Endonuclease I Assay with Four crRNAs

| No | Mutant | crRNA-1* | Std Dev | crRNA-2* | Std Dev | crRNA-3* | Std Dev | crRNA-4* | Std Dev |
|---|---|---|---|---|---|---|---|---|---|
| 39 | G146R/E795Q/D665N | 41.73 | 0.38 | 22.97 | 1.05 | 30.27 | 0.23 | 35.73 | 1.45 |
| 40 | G146R/E795Q/E981V | 50.70 | 5.98 | 29.33 | 1.81 | 26.63 | 1.01 | 36.00 | 0.95 |
| 41 | G146R/E795Q/T814K | 56.57 | 0.67 | 26.50 | 0.70 | 27.63 | 6.03 | 42.40 | 0.95 |
| 42 | G146R/R182V/D665N | 36.67 | 0.91 | 25.30 | 1.83 | 33.20 | 1.35 | 36.57 | 0.31 |
| 43 | E125K/R182V/E981V | 22.43 | 1.62 | 15.93 | 0.81 | 19.33 | 0.91 | 21.50 | 0.61 |
| 44 | R182V/P799V/E981V | 63.57 | 0.25 | 25.67 | 0.64 | 39.40 | 1.80 | 37.60 | 9.09 |
| 45 | R182V/T814K/E981V | 52.93 | 0.55 | 27.93 | 0.58 | 36.97 | 0.81 | 40.50 | 1.13 |
| 46 | G146R/P799V/E981V | 23.27 | 5.63 | 27.33 | 0.76 | 20.43 | 0.80 | 13.60 | 0.70 |
| 47 | G146R/R182V/E795Q/F81E | 60.07 | 0.64 | 30.73 | 0.47 | 39.00 | 0.53 | 45.23 | 1.86 |
| 48 | G146R/R182V/E795Q/E125K | 27.90 | 0.79 | 14.03 | 1.00 | 16.33 | 0.23 | 21.97 | 0.78 |
| 49 | G146R/R182V/E795Q/E125A | 49.30 | 1.20 | 29.93 | 1.06 | 32.00 | 0.56 | 38.17 | 1.63 |
| 50 | G146R/R182V/E795Q/P799V | 44.93 | 0.61 | 44.50 | 0.36 | 38.83 | 0.59 | 27.87 | 0.59 |
| 51 | G146R/R182V/E795Q/T814K | 58.07 | 0.59 | 38.43 | 0.38 | 38.93 | 0.87 | 46.50 | 1.31 |
| 52 | G146R/R182V/E795Q/E981V | 41.60 | 2.07 | 33.23 | 0.57 | 27.13 | 0.25 | 37.63 | 0.90 |
| 53 | G146R/R182V/E795Q/D665N | 36.60 | 0.36 | 27.33 | 1.12 | 31.50 | 0.61 | 33.73 | 0.55 |
| 54 | G146R/R182V/P799V/E981V | 19.57 | 0.93 | 25.83 | 0.91 | 14.70 | 0.10 | 10.80 | 0.53 |
| 55 | E125K/G146R/R182V/E795Q/D665N | 10.50 | 1.04 | 11.13 | 0.55 | 8.67 | 0.76 | 10.67 | 1.22 |
| 56 | G146R/R182V/E795Q/P799V/T814K | 32.60 | 1.91 | 37.37 | 1.55 | 24.23 | 0.42 | 19.07 | 0.90 |
| 57 | E125K/G146R/R182V/E795Q/D665N/E981V | 7.50 | 2.51 | 5.87 | 2.32 | 6.00 | 0.46 | 5.97 | 0.92 |

*Activity is the mean of three replicates.

TABLE 11

LbCas12a Mutant Editing Activity Relative to Wild-Type with Four crRNAs

| No. | Mutant | crRNA-1 | crRNA-2 | crRNA-3 | crRNA-4 |
|---|---|---|---|---|---|
| 0 | Wild-Type (WT) | 1 | 1 | 1 | 1 |
| 1 | F81E | 1.27 | 1.38 | 1.88 | 1.82 |
| 2 | E125K | 0.8 | 1.61 | 1.41 | 1.26 |
| 3 | N145R | 1.13 | 1.28 | 1.46 | 1.45 |
| 4 | G146R | 1.08 | 2.03 | 1.99 | 1.93 |
| 5 | T152K | 1.09 | 2.83 | 2.13 | 1.2 |
| 6 | R182V | 1.24 | 1.52 | 2.08 | 1.8 |
| 7 | V491D | 1.06 | 1.19 | 1.25 | 1.36 |
| 8 | K478R | 0.99 | 1.09 | 1.24 | 1.4 |
| 9 | N582R | 0.91 | 1.5 | 1.41 | 1.3 |
| 10 | Y606F | 0.9 | 1.21 | 0.93 | 0.93 |
| 11 | Y646H | 1.14 | 1.06 | 0.79 | 0.88 |
| 12 | D665N | 0.9 | 1.27 | 1.4 | 1.24 |
| 13 | E795Q | 1.19 | 1.37 | 1.52 | 1.68 |
| 14 | P799V | 1.12 | 2.13 | 2.3 | 1.99 |
| 15 | L839F | 1.03 | 0.85 | 1.17 | 1.21 |
| 16 | I841A | 0.95 | 1.07 | 1.12 | 1.11 |
| 17 | E858V | 1.06 | 1 | 1.2 | 1.29 |
| 18 | I860R | 0.99 | 1 | 1.19 | 1.25 |
| 19 | W890A | 0.11 | 0.54 | 0.38 | 0.29 |
| 20 | E898N | 0.9 | 0.81 | 0.74 | 0.98 |
| 21 | H909K | 0.96 | 0.98 | 1.08 | 0.91 |
| 22 | E913R | 1 | 1.03 | 1.12 | 1.23 |

TABLE 11-continued

LbCas12a Mutant Editing Activity Relative to Wild-Type with Four crRNAs

| No. | Mutant | crRNA-1 | crRNA-2 | crRNA-3 | crRNA-4 |
|---|---|---|---|---|---|
| 23 | E981V | 1.1 | 1.72 | 1.72 | 1.57 |
| 24 | S1020E | 0.34 | 0.62 | 0.49 | 0.51 |
| 25 | K1121D | 0.31 | 0.54 | 0.46 | 0.46 |
| 26 | E88A/E795Q | 0.92 | 1.14 | 1.25 | 1.39 |
| 27 | E125K/E795Q | 0.9 | 2.01 | 1.98 | 1.7 |
| 28 | G146R/E795Q | 1.14 | 2.31 | 2.07 | 2.14 |
| 29 | R182V/E795Q | 1.37 | 1.96 | 2.73 | 2.7 |
| 30 | V491D/E795Q | 1.28 | 1.65 | 2.38 | 2.34 |
| 31 | Q529I/E795Q | 1.16 | 0.99 | 1.22 | 1.21 |
| 32 | Y646H/E795Q | 1.28 | 1.46 | 1.52 | 2.42 |
| 33 | D665N/E795Q | 1.16 | 1.87 | 2.3 | 2.11 |
| 34 | T814K/E795Q | 1.15 | 1.57 | 1.85 | 2.08 |
| 35 | L839F/E795Q | 1.15 | 1.31 | 1.85 | 1.92 |
| 36 | Q906F/E795Q | 1.15 | 1.72 | 1.65 | 0.88 |
| 37 | E795Q/Q1170D | 1.09 | 1.3 | 1.37 | 1.45 |
| 38 | G146R/R182V/E795Q | 1.19 | 3.83 | 3.1 | 2.91 |
| 39 | G146R/E795Q/D665N | 0.75 | 2.73 | 2.21 | 2.01 |
| 40 | G146R/E795Q/E981V | 0.9 | 3.41 | 2.03 | 2.02 |
| 41 | G146R/E795Q/T814K | 1.06 | 3.11 | 2.18 | 2.39 |
| 42 | G146R/R182V/D665N | 0.65 | 2.97 | 2.36 | 1.97 |
| 43 | E125K/R182V/E981V | 0.41 | 1.89 | 1.36 | 1.21 |
| 44 | R182V/P799V/E981V | 1.21 | 2.98 | 2.81 | 2.2 |
| 45 | R182V/T814K/E981V | 0.99 | 3.1 | 2.72 | 2.3 |
| 46 | G146R/P799V/E981V | 0.41 | 2.94 | 1.4 | 0.76 |
| 47 | G146R/R182V/E795Q/F81E | 1.1 | 3.46 | 2.88 | 2.53 |
| 48 | G146R/R182V/E795Q/E125K | 0.48 | 1.58 | 1.17 | 1.16 |
| 49 | G146R/R182V/E795Q/E125A | 0.86 | 3.28 | 2.28 | 2.2 |
| 50 | G146R/R182V/E795Q/P799V | 0.78 | 4.85 | 2.75 | 1.49 |
| 51 | G146R/R182V/E795Q/T814K | 1.02 | 4.22 | 2.81 | 2.56 |
| 52 | G146R/R182V/E795Q/E981V | 0.71 | 3.71 | 1.96 | 2.05 |
| 53 | G146R/R182V/E795Q/D665N | 0.62 | 3.09 | 2.28 | 1.89 |
| 54 | G146R/R182V/P799V/E981V | 0.35 | 2.86 | 1.05 | 0.7 |
| 55 | E125K/G146R/R182V/E795Q/D665N | 0.21 | 1.27 | 0.71 | 0.7 |
| 56 | G146R/R182V/E795Q/P799V/T814K | 0.56 | 4.06 | 1.67 | 1.44 |
| 57 | E125K/G146R/R182V/E795Q/D665N/E981V | 0.16 | 0.76 | 0.49 | 0.39 |

SEQUENCE LISTING (5320 sequences)

SEQ ID NO: 1 - DNA, 3684 bp, Lachnospiraceae bacterium ND2006
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2 - protein, 1228 aa, Lachnospiraceae bacterium ND2006
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 3 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtatgatcaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 4 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYDQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 5 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcccgaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 6 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSPKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 7 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaacgtaaaattgcgatcagcaataaagagtggctggaatacgcacagaccagcgttaaacat

SEQ ID NO: 8 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKRKIAISNKEWLEYAQTSVKH

SEQ ID NO: 9 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacgcgaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 10 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDAKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 11 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatccggttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 12 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDPVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 13 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatcgtaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 14 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHRTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 15 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaatctgcatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 16 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENLHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 17 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttcgtgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 18 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVRALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 19 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtaccagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 20 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGTSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 21 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgaccatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 22 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELTMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 23 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaagaaaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 24 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKENVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 25 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatctttgaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 26 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIFEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 27 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatccgagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 28 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNPSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 29 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtggcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 30 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGGSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 31 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattcgtcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 32 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIRRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 33 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgcagctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 34 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPQLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 35 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaataccgtcagaccagcgttaaacat

SEQ ID NO: 36 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYRQTSVKH

SEQ ID NO: 37 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacagcgtctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 38 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQRLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 39 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaatatttgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 40 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINICPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 41 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatgtgggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 42 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDVGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 43 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagttttctggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 44 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFSGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 45 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtccgaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 46 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCPTGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 47 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaaaacctgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 48 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKNLKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 49 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacgatctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 50 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNDLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 51 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacatttataacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 52 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYIYNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 53 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagaccaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 54 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGETKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 55 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgcctctagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 56 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIASSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 57 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttatgaaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 58 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVMKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 59 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaaacccaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 60 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYETQENAILPKNADANGAYNIARKVLWAIGQFKKAEDEKLDKVKIAISNKEWLEYAQTSVKH

SEQ ID NO: 61 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatctttaaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 62 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAIFKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 63 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagctttgtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 64 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISFVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 65 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtccaggatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 66 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVQDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 67 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattgaaccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 68 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETIEPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 69 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttaaaaaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 70 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVKKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 71 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcacccagtttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 72 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTQFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 73 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcgcgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 74 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESASFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 75 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatattctaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 76 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYSNLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 77 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgcgaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 78 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVAKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 79 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgccggtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 80 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPPVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 81 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctattatgtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 82 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYYVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 83 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatctgcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 84 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHLQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 85 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatctgagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 86 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYLSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 87 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaatttttgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 88 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINFCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 89 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgtttgccat

SEQ ID NO: 90 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVCH

SEQ ID NO: 91 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaccctgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 92 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHTLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 93 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgcccgaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 94 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCPKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 95 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgcgaatatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 96 - protein, 1228 aa, Artificial Sequence
  Synthetic
MSKLEKFTNCYSLSKTLRFKAIPVGKTQENIDNKRLLVEDEKRAEDYKGVKKLLDREYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 97 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgaccgtgtacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 98 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTVYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 99 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattcgtctggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 100 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIRLEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 101 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaagcgaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 102 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGEANLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 103 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacgaagtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 104 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNEVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 105 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggatattggccagtttaagaaagcagaagatgagaagctggacaaagtgaaaattgcgatcagcaataaagagtggctggaatacgcacagaccagcgttaaacat

SEQ ID NO: 106 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWDIGQFKKAEDEKLDKVKIAISNKEWLEYAQTSVKH

SEQ ID NO: 107 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttgatctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 108 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFDLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 109 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctactctaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 110 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYSNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 111 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattgtgaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 112 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIVKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 113 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgtgattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 114 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNVIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 115 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgcgtgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 116 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLREYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 117 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaagaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 118 - protein, 1228 aa, Artificial Sequence
  Synthetic
MSKLEKFTNCYSLSKTLRFKAIPVGKTQENIDNKRLLVEDEERAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 119 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatgaatatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 120 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHEYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 121 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtctggccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 122 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGLAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 123 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccgaagccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 124 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSEADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 125 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacaccatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 126 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYTINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 127 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgccgctgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 128 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTPLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 129 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatggataatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 130 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMDNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 131 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaattggttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 132 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNWFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 133 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggccgtgaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 134 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGRETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 135 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcgataaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 136 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCDKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 137 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttatattagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 138 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYISLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 139 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgtttttgaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 140 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVFEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 141 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggtttttgaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 142 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVFEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 143 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattctgcctggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 144 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFCLDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 145 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgtaacagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 146 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRNSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 147 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcatgcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 148 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSMRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 149 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcgattatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 150 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSDYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 151 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgtgcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 152 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVCDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 153 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaagaagcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 154 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKEADANGAYNIARKVLWAIGQFKKAEDEKLDKVKIAISNKEWLEYAQTSVKH

SEQ ID NO: 155 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatcgttttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 156 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNRFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 157 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagcgaaaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 158 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSENYEAQENAILPKNADANGAYNIARKVLWAIGQFKKAEDEKLDKVKIAISNKEWLEYAQTSVKH

SEQ ID NO: 159 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtaacaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 160 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCNTGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 161 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacggcgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 162 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINGEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 163 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgttatagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 164 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRYSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 165 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatcgtaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 166 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNRNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 167 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaagtgggtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 168 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKWVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 169 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattgtgctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 170 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIVLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 171 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttattttgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 172 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYFAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 173 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcaccctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 174 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFTLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 175 - DNA, 3684 bp, Artificial Sequence
  Synthetic
atgagcaaactggaaaagttcaccaactgttatagcctgagcaaaaccctgcgttttaaagcaattccgcatggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 176 - protein, 1228 aa, Artificial Sequence
  Synthetic
MSKLEKFTNCYSLSKTLRFKAIPHGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 177 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgaaaggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 178 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLKGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 179 - DNA, 3684 bp, Artificial Sequence
  Synthetic
atgagcaaactggaaaagttcaccaactgtgaaagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 180 - protein, 1228 aa, Artificial Sequence
  Synthetic
MSKLEKFTNCESLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 181 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaaacctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 182 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKNLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 183 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgcgtgtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 184 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPRVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 185 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaactggctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 186 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNWLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 187 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaagcgtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 188 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKASNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 189 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggaccgtccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 190 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDRPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 191 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaatggtttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 192 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEWFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 193 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttcatctgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 194 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFHLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 195 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttattgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 196 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFIDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 197 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaacctgaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 198 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINLKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 199 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaaggatttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 200 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKDFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 201 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaactctgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 202 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNSVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 203 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccaccctgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 204 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGATLFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 205 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgccgggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 206 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVPGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 207 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgatagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 208 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESDSKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 209 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatcatccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 210 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANHPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 211 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaacctggaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 212 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETWKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 213 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccatttctgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 214 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSISDSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 215 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaggcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 216 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKGFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 217 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagctttatgggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 218 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFMGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 219 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatccgtaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 220 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIRTILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 221 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctggcgatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 222 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLAMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 223 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcatgtttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 224 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGMFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 225 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcatgggatgagaagctggacaaagtgaaaattgcgatcagcaataaagagtggctggaatacgcacagaccagcgttaaacat

SEQ ID NO: 226 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAWDEKLDKVKIAISNKEWLEYAQTSVKH

SEQ ID NO: 227 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttaccaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 228 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFTNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 229 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacattctgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 230 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHILIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 231 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaaggcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 232 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKGEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 233 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcattaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 234 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIIINFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 235 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgcgatattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 236 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRDINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 237 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccaggtgaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 238 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQVTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 239 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattattgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 240 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIIDSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 241 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttctgagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 242 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVLSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 243 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacgaaaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 244 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADEKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 245 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcgtgaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 246 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIIVNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 247 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatctctattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 248 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHISIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 249 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattcgtaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 250 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIRNNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 251 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcagtgctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 252 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRAVLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 253 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctggaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 254 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESWKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 255 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagattggcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 256 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDWRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 257 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatttccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 258 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKFPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 259 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgtgggatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 260 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLWDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 261 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttaacgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 262 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVNDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 263 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaacttttctggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 264 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFSGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 265 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgcgcgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 266 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGARNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 267 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgataccgttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 268 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDTVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 269 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttctgcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 270 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFCKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 271 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgactctctgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 272 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDSLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 273 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaaatttcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 274 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKISISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 275 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaacagttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 276 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKQFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 277 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatccatcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 278 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATIHRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 279 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtctggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 280 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGLAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 281 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagataaaagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 282 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDKSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 283 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacgaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 284 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYELLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 285 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgctgaaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 286 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLLNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 287 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctgtttaaagtgaaaattgcgatcagcaataaagagtggctggaatacgcacagaccagcgttaaacat

SEQ ID NO: 288 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLFKVKIAISNKEWLEYAQTSVKH

SEQ ID NO: 289 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgggcctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 290 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLGLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 291 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaaaaattctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 292 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKKFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 293 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatatgaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 294 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNMNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 295 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcaccatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 296 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSTMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 297 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagctgttcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 298 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQLFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 299 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggtatgcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 300 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWYAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 301 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaagatgcgatcagcaataaagagtggctggaatacgcacagaccagcgttaaacat

SEQ ID NO: 302 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKDAISNKEWLEYAQTSVKH

SEQ ID NO: 303 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtcagtttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 304 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGQFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 305 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacattgtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 306 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHIVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 307 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagatatgatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 308 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDMISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 309 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagcagcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 310 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQQRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 311 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgttctaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 312 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARSNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 313 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatgtgtattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 314 - protein, 1228 aa, Artificial Sequence
  Synthetic
MSKLEKFTNCYSLSKTLRFKAIPVGKTQENIDNKRLLVEDEKRAEDYKGVKKLLDVYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 315 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcgattttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 316 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISDFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 317 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatgggcgaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 318 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWANAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 319 - DNA, 3684 bp, Artificial Sequence
  Synthetic
atgagcaaactggaaaagttcaccaactgttatagctgcagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 320 - protein, 1228 aa, Artificial Sequence
  Synthetic
MSKLEKFTNCYSCSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 321 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcagatgaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 322 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEADENAILPKNADANGAYNIARKVLWAIGQFKKAEDEKLDKVKIAISNKEWLEYAQTSVKH

SEQ ID NO: 323 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagcagaagaaagcagaagatgagaagctggacaaagtgaaaattgcgatcagcaataaagagtggctggaatacgcacagaccagcgttaaacat

SEQ ID NO: 324 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQQKKAEDEKLDKVKIAISNKEWLEYAQTSVKH

SEQ ID NO: 325 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagggcaagaaagcagaagatgagaagctggacaaagtgaaaattgcgatcagcaataaagagtggctggaatacgcacagaccagcgttaaacat

SEQ ID NO: 326 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQGKKAEDEKLDKVKIAISNKEWLEYAQTSVKH

SEQ ID NO: 327 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttccgtaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 328 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFRNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 329 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggctgggaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 330 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGWETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 331 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaatttctaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 332 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEISNNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 333 - DNA, 3684 bp, Artificial Sequence
  Synthetic
atgagcaaactgtataagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 334 - protein, 1228 aa, Artificial Sequence
  Synthetic
MSKLYKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 335 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtaccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 336 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRTTILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 337 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaagaaagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 338 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKESRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 339 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatgggcctgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 340 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMGLMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 341 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataacaaaggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 342 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNKGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 343 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagccgtcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 344 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSRRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 345 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatctctaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 346 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIISTILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 347 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaacataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 348 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDEHNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 349 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatgcgtctgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 350 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMRLMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 351 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttgataacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 352 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFDNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 353 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggctttgaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 354 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGFETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 355 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaacagctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 356 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEQLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 357 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacctctgaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 358 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTSEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 359 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgtttgcgaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 360 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVCEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 361 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatctataacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 362 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKIYNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 363 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcatgatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 364 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSMIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 365 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagccagtatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 366 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSQYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 367 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccagatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 368 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIQIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 369 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcctgttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 370 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGLFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 371 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaatctctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 372 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKSLENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 373 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttcgtgccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 374 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVRAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 375 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtgcgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 376 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCATSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 377 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatgatagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 378 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADDSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 379 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgataaagttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 380 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDKVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 381 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattattcagtttaagaaagcagaagatgagaagctggacaaagtgaaaattgcgatcagcaataaagagtggctggaatacgcacagaccagcgttaaacat

SEQ ID NO: 382 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIIQFKKAEDEKLDKVKIAISNKEWLEYAQTSVKH

SEQ ID NO: 383 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaactatgattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 384 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNYDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 385 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgcatagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 386 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMHSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 387 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgggcagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 388 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLGSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 389 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctgaacaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 390 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLNKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 391 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaaggatgaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 392 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKDEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 393 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgatttttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 394 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPIFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 395 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatcggcctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 396 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIGLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 397 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttccgaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 398 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFPKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 399 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaaccaggtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 400 - protein, 1228 aa, Artificial Sequence
  Synthetic
MSKLEKFTNCYSLSKTLRFKAIPVGKTQENIDNKRLLVEDEKRAEDYKGVKKLLDRYYLSFINQVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 401 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcaacccgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 402 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIATRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 403 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagttaaactgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 404 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVKLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 405 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgtctgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 406 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLSDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 407 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgattatgattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 408 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDYDFLISPVKNSDGIFYDSRNYEAQENAILPKNADANGAYNIARKVLWAIGQFKKAEDEKLDKVKIAISNKEWLEYAQTSVKH

SEQ ID NO: 409 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttgtggaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 410 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVVESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 411 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttccagaaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 412 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFQKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 413 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgccgaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 414 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPPKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 415 - DNA, 3684 bp, Artificial Sequence
  Synthetic
atgagcaaactggaaaagttcaccaactgtcagagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 416 - protein, 1228 aa, Artificial Sequence
  Synthetic
MSKLEKFTNCQSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 417 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgggcctgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 418 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTGLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 419 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaatataacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 420 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKYNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 421 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgtatattgcgatcagcaataaagagtggctggaatacgcacagaccagcgttaaacat

SEQ ID NO: 422 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVYIAISNKEWLEYAQTSVKH

SEQ ID NO: 423 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttattagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 424 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFISASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 425 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttgaaaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 426 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFEKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 427 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcaaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 428 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIKTILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 429 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaagaacatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 430 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKEHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 431 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttggcccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 432 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVGPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 433 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaatttaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 434 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKFNKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 435 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcctggaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 436 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGLETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 437 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggctatgaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 438 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGYETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 439 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgatttataacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 440 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIYNKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 441 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcaacaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 442 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIINTILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 443 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggtgattggccagtttaagaaagcagaagatgagaagctggacaaagtgaaaattgcgatcagcaataaagagtggctggaatacgcacagaccagcgttaaacat

SEQ ID NO: 444 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWVIGQFKKAEDEKLDKVKIAISNKEWLEYAQTSVKH

SEQ ID NO: 445 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagtttattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 446 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKFIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 447 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttgcgagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 448 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVASFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 449 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattggcctggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 450 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIGLEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 451 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaagtgctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 452 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEVLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 453 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcataccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 454 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGHTDVDFLISPVKNSDGIFYDSRNYEAQENAILPKNADANGAYNIARKVLWAIGQFKKAEDEKLDKVKIAISNKEWLEYAQTSVKH

SEQ ID NO: 455 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcatgaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 456 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFMKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 457 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgtaccagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 458 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRTSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 459 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaaggcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 460 - protein, 1228 aa, Artificial Sequence
  Synthetic
MSKLEKFTNCYSLSKTLRFKAIPVGKTQENIDNKGLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 461 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaaccagaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 462 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNQTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 463 - DNA, 3684 bp, Artificial Sequence
  Synthetic
atgagcaaactggaaaagttcaccaactgttatagcctgagcaaaaccctgcgttttaaaaacattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 464 - protein, 1228 aa, Artificial Sequence
  Synthetic
MSKLEKFTNCYSLSKTLRFKNIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 465 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaatataatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 466 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKYNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 467 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctgctgagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 468 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLLSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 469 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcccggaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 470 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRPEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 471 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagccataaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 472 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSHKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 473 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgtctgatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 474 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMSDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 475 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaacagatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 476 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKQMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 477 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggttgctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 478 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGCFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 479 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaagatttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 480 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDEDFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 481 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaattattgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 482 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINYCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 483 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgaaattcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 484 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAKFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 485 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgcataaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 486 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPHKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 487 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgtctgacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 488 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLSDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 489 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaatctctggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 490 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKESLVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 491 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatattggaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 492 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYWNLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 493 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgacgaaatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 494 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADEIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 495 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaatgcgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 496 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSECEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 497 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaatttgccagtttaagaaagcagaagatgagaagctggacaaagtgaaaattgcgatcagcaataaagagtggctggaatacgcacagaccagcgttaaacat

SEQ ID NO: 498 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAICQFKKAEDEKLDKVKIAISNKEWLEYAQTSVKH

SEQ ID NO: 499 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattgaaaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 500 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIENNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 501 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacaccattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 502 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNTIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 503 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgcgaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 504 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIATILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 505 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaccaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 506 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIITNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 507 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcaggcgaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 508 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQATNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 509 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcatatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 510 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIHIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 511 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaacttttttgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 512 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFFEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 513 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagtttatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 514 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQFIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 515 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcatttatggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 516 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSIYGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 517 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaataccgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 518 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNTDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 519 - DNA, 3684 bp, Artificial Sequence
  Synthetic
atgagcaaactggaaaagttcaccaactgttatagcctgagcaaaaccctgcgttttaaatttattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 520 - protein, 1228 aa, Artificial Sequence
  Synthetic
MSKLEKFTNCYSLSKTLRFKFIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 521 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatccatgaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 522 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIHELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 523 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatataccgatattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 524 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTDIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 525 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcattgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 526 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFIADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 527 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcaggtgttcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 528 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQVFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 529 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaactttctaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 530 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELSNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 531 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatataccgaaattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 532 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTEIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 533 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagccagaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 534 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSQKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 535 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaacaggccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 536 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEQALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 537 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagctgcatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 538 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSCIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 539 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaggcttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 540 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKGFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 541 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgatgcggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 542 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDAEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 543 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacgatttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 544 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDDFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 545 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaagaatttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 546 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKEFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 547 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagttatgctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 548 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVMLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 549 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtcaggaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 550 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSQENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 551 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatgaagttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 552 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDEVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 553 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaccggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 554 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKPAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 555 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttataccgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 556 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYTEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 557 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaaccaggtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 558 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNQVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 559 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattggcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 560 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIGNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 561 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataacaccggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 562 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNTGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 563 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccgttttaagaaagcagaagatgagaagctggacaaagtgaaaattgcgatcagcaataaagagtggctggaatacgcacagaccagcgttaaacat

SEQ ID NO: 564 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGRFKKAEDEKLDKVKIAISNKEWLEYAQTSVKH

SEQ ID NO: 565 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctgaaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 566 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELKNLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 567 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccctggatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 568 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTLDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 569 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattctgatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 570 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPILINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 571 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcgcggagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 572 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSAENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 573 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagtatctgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 574 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQYLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 575 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaataaaaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 576 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNKNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 577 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaaaccaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 578 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKTKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 579 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcatctaccagcgttaaacat

SEQ ID NO: 580 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYASTSVKH

SEQ ID NO: 581 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccccgagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 582 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTPSGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 583 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccggaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 584 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPEKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 585 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagctttaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 586 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSFTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 587 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaatatggatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 588 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNMDGIFYDSRNYEAQENAILPKNADANGAYNIARKVLWAIGQFKKAEDEKLDKVKIAISNKEWLEYAQTSVKH

SEQ ID NO: 589 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagtggatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 590 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQWIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 591 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcggcaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 592 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSGKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 593 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggctgcgaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 594 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGCETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 595 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcccggtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 596 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSPVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 597 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgatgatgcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 598 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDDAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 599 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgttatagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 600 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRYSLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 601 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaacattatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 602 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKHYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 603 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcatggaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 604 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGMETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 605 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtgatgtttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 606 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVMFLISPVKNSDGIFYDSRNYEAQENAILPKNADANGAYNIARKVLWAIGQFKKAEDEKLDKVKIAISNKEWLEYAQTSVKH

SEQ ID NO: 607 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagaaagtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 608 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICEKVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 609 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttcctgattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 610 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFLIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 611 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaccgaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 612 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKETERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 613 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttctgcaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 614 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFCKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 615 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgatattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 616 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENDILPKNADANGAYNIARKVLWAIGQFKKAEDEKLDKVKIAISNKEWLEYAQTSVKH

SEQ ID NO: 617 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgatgaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 618 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDEAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 619 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatctgaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 620 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDLKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 621 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcgcggaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 622 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGAETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 623 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaacctggggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 624 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATWGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 625 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgattgcgcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 626 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDCAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 627 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccgcggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 628 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIAAVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 629 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcaacaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 630 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFNKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 631 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatcagcgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 632 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNQRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 633 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccgccgaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 634 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPPNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 635 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagcatggtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 636 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSMVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 637 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagcgtgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 638 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKRDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 639 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtccgtaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 640 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVRKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 641 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattttaacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 642 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYFNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 643 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcacctctaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 644 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTSKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 645 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttgtgaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 646 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFVKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 647 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttcagctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 648 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFQLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 649 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccgaccgaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 650 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPTEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 651 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccgtgtttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 652 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAVFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 653 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatgcattattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 654 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMHYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 655 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttctataactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 656 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFYNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 657 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatccgctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 658 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYPLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 659 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgatacccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 660 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDTHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 661 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcatttaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 662 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESAFKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 663 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcccggaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 664 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGPETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 665 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgaaatttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 666 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVKFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 667 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttaaaaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 668 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFKNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 669 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtgaaccagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 670 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVNQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 671 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttaacaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 672 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFNKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 673 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcaaccgaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 674 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEATENAILPKNADANGAYNIARKVLWAIGQFKKAEDEKLDKVKIAISNKEWLEYAQTSVKH

SEQ ID NO: 675 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacaaaattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 676 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHKIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 677 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcccgggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 678 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSPGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 679 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagatggcatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 680 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDGISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 681 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaccaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 682 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKTNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 683 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagcttttgcagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 684 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFCSASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 685 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgccgaaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 686 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLPNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 687 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggtgatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 688 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLVIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 689 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtattgtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 690 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISIVKNSDGIFYDSRNYEAQENAILPKNADANGAYNIARKVLWAIGQFKKAEDEKLDKVKIAISNKEWLEYAQTSVKH

SEQ ID NO: 691 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatggcattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 692 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYGILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 693 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaaaggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 694 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFKGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 695 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagtttctgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 696 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQFLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 697 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcaaaagattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 698 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFAKDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 699 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcccgaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 700 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSPKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 701 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagcctttccgggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 702 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFPGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 703 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaatgctacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 704 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKCYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 705 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcgtgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 706 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIVIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 707 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcggcaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 708 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFGNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 709 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtggtgcattggccagtttaagaaagcagaagatgagaagctggacaaagtgaaaattgcgatcagcaataaagagtggctggaatacgcacagaccagcgttaaacat

SEQ ID NO: 710 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWCIGQFKKAEDEKLDKVKIAISNKEWLEYAQTSVKH

SEQ ID NO: 711 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaggcaaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 712 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDEGNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 713 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatggcgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 714 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYGVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 715 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggttttgcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 716 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGFAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 717 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattaccaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 718 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEITNNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 719 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgtcatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 720 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRHPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 721 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatctatattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 722 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIYIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 723 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacgataagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 724 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADDKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 725 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgatccggatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 726 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDPDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 727 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaagataatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 728 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKEDNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 729 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaaggcaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 730 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKGKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 731 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatatggactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 732 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDMDYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 733 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaagatggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 734 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKDGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 735 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcgatgaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 736 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGDETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 737 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgcgtaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 738 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKARKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 739 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgtctaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 740 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLSKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 741 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttactttaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 742 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYFKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 743 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagaacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 744 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEEQENAILPKNADANGAYNIARKVLWAIGQFKKAEDEKLDKVKIAISNKEWLEYAQTSVKH

SEQ ID NO: 745 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatctgcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 746 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDLRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 747 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttctgcgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 748 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFCENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 749 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattgaaccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 750 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLIEPVKNSDGIFYDSRNYEAQENAILPKNADANGAYNIARKVLWAIGQFKKAEDEKLDKVKIAISNKEWLEYAQTSVKH

SEQ ID NO: 751 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtgcgaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 752 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGAKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 753 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagtctatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 754 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKESILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 755 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaatgggagaagctggacaaagtgaaaattgcgatcagcaataaagagtggctggaatacgcacagaccagcgttaaacat

SEQ ID NO: 756 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEWEKLDKVKIAISNKEWLEYAQTSVKH

SEQ ID NO: 757 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgtatacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 758 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLYTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 759 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactattggagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 760 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYWSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 761 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgaccgattacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 762 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTDYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 763 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacaacagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 764 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNNSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 765 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgttggagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 766 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRWSLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 767 - DNA, 3684 bp, Artificial Sequence
  Synthetic
atgagcaaactggaaaagttcaccaactgttatagcctgagcaaaaccctgcgtgataaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 768 - protein, 1228 aa, Artificial Sequence
  Synthetic
MSKLEKFTNCYSLSKTLRDKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 769 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcgcggagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 770 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIAEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 771 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggccaggaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 772 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGQETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 773 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagtggatgagaagctggacaaagtgaaaattgcgatcagcaataaagagtggctggaatacgcacagaccagcgttaaacat

SEQ ID NO: 774 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAVDEKLDKVKIAISNKEWLEYAQTSVKH

SEQ ID NO: 775 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctataccgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 776 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYTDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 777 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgactataagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 778 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADYKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 779 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaactgctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 780 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNCFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 781 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacaccgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 782 - protein, 1228 aa, Artificial Sequence
  Synthetic
MSKLEKFTNCYSLSKTLRFKAIPVGKTQENIDNKRLLVEDEKRAEDYKGVKKLLDRYYLSFINTVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 783 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggtgggtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 784 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWWVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 785 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttcagaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 786 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFQNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 787 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattcagaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 788 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIQNNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 789 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagcaggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 790 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKEQENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 791 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttccagaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 792 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFQNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 793 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcatgaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 794 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIIMNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 795 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatctgagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 796 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDLSFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 797 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgtgaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 798 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIVTILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 799 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatgaaaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 800 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYENRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 801 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctggaacgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 802 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLERKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 803 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggctctgaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 804 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGSETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 805 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagcagaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 806 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQQTNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 807 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtctgtttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 808 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGLFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 809 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctgaaatacgcacagaccagcgttaaacat

SEQ ID NO: 810 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLKYAQTSVKH

SEQ ID NO: 811 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattacctggcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 812 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITWRTDVDFLISPVKNSDGIFYDSRNYEAQENAILPKNADANGAYNIARKVLWAIGQFKKAEDEKLDKVKIAISNKEWLEYAQTSVKH

SEQ ID NO: 813 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgttgcaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 814 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCCTGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 815 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatcgtgatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 816 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADRDLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 817 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgccgaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 818 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPPKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 819 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcattgcatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 820 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHCICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 821 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatcgtcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 822 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDRQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 823 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaatttctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 824 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINEFLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 825 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatctgcaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 826 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIICTILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 827 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaacagaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 828 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKQNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 829 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacatggagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 830 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTWSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 831 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggtgcatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 832 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVVHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 833 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgttttatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 834 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLFYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 835 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccaggcgaagaaagcagaagatgagaagctggacaaagtgaaaattgcgatcagcaataaagagtggctggaatacgcacagaccagcgttaaacat

SEQ ID NO: 836 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQAKKAEDEKLDKVKIAISNKEWLEYAQTSVKH

SEQ ID NO: 837 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggctggaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 838 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGWNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 839 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaatctatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 840 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQSIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 841 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgacccgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 842 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLTRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 843 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcaccaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 844 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIITTILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 845 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaactggcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 846 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFELASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 847 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatccatggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 848 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIHGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 849 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccatatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 850 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIHIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 851 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagctggaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 852 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSWKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 853 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgtttttttgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 854 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFFEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 855 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagtattataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 856 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEYYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 857 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcatgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 858 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCMKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 859 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatataacgatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 860 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYNDADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 861 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggtgaaaccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 862 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGETSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 863 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataactctaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 864 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNSKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 865 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattctgaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 866 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYILNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 867 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgttgcaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 868 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRCTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 869 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaagatctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 870 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEDLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 871 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatccagaaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 872 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIQKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 873 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaaattttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 874 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKIFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 875 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcctgaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 876 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIILNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 877 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacagatttatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 878 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQIYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 879 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgtgagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 880 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFVSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 881 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggctgcctgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 882 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGCLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 883 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgaccaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 884 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMTNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 885 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggtttgcgaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 886 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVCEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 887 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaatattttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 888 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKYFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

(The sequence listing continues in the following parts.)

What is claimed:

1. An isolated mutant *Lachnospiraceae bacterium* ND2006 Cas12a ("LbCas12a") polypeptide comprising the G146R/R182V/E795Q polypeptide sequence of SEQ ID NO: 39844.

2. An isolated polynucleotide sequence encoding the mutant LbCas12a polypeptide of claim 1, wherein the polynucleotide sequence comprises the sequence of SEQ ID NO: 3983.

* * * * *